(12) United States Patent
Domon et al.

(10) Patent No.: US 7,960,100 B1
(45) Date of Patent: Jun. 14, 2011

(54) COLON CANCER TARGETS AND USES THEREOF

(75) Inventors: Bruno Domon, Rockville, MD (US); Aiqun Li, Rockville, MD (US); Tao He, North Potomac, MD (US); Ian McCaffery, Westlake Village, MD (US)

(73) Assignee: Celera Corporation, Alameda, CA (US)

( * ) Notice: Subject to any disclaimer, the term of this patent is extended or adjusted under 35 U.S.C. 154(b) by 236 days.

(21) Appl. No.: 12/077,323

(22) Filed: Mar. 17, 2008

Related U.S. Application Data

(62) Division of application No. 11/085,606, filed on Mar. 22, 2005, now abandoned.

(60) Provisional application No. 60/566,425, filed on Apr. 30, 2004, provisional application No. 60/576,812, filed on Jun. 4, 2004.

(51) Int. Cl.
*C12Q 1/00* (2006.01)
*G01N 33/574* (2006.01)

(52) U.S. Cl. .............................. 435/4; 435/7.1; 435/7.23

(58) Field of Classification Search .................. None
See application file for complete search history.

(56) References Cited

U.S. PATENT DOCUMENTS

2006/0188883 A1* 8/2006 Murray et al. .................... 435/6
2006/0199179 A1* 9/2006 Nakamura et al. ................. 435/6

FOREIGN PATENT DOCUMENTS

WO 2004028479 A2 4/2004

OTHER PUBLICATIONS sequence search result (Karichetic), 2010.*

* cited by examiner

*Primary Examiner* — Misook Yu
*Assistant Examiner* — Lei Yao

(57) ABSTRACT

The present invention provides a method for diagnosing and detecting diseases associated with colon. The present invention provides one or more proteins or fragments thereof, peptides or nucleic acid molecules differentially expressed in colon diseases (CCAT) and antibodies binds to CCAT. The present invention provides that CCAT is used as targets for screening agents that modulates the CCAT activities. Further the present invention provides methods for treating diseases associated with colon.

3 Claims, 10 Drawing Sheets

COLON CANCER TARGETS AND USES THEREOF

CROSS-REFERENCE TO RELATED APPLICATIONS

This application is a divisional application of U.S. nonprovisional application Ser. No. 11/085,606, filed Mar. 22, 2005 and now abandoned, which claims priority to U.S. provisional application Ser. No. 60/566,425, filed Apr. 30, 2004, and U.S. provisional application Ser. No. 60/576,812, filed Jun. 4, 2004.

FIELD OF THE INVENTION

This invention relates to the fields of molecular biology and oncology. Specifically, the invention provides a molecular marker and a therapeutic agent for use in the diagnosis and treatment of colon diseases.

BACKGROUND OF THE INVENTION

Cancer currently constitutes the second most common cause of death in the United States. Carcinomas of the colon are the eighth most prevalent form of cancer and fourth among the most common causes of cancer deaths in this country. The incidence of colon cancer has been increasing steadily in the past twenty years in most industrialized countries, exhibiting the characteristics of a growing epidemiological problem. In the year 2000, for example, an estimated 28,600 deaths will be ascribed to this type of cancer and approximately 28,600 new cases will be diagnosed.

Colon cancer is the second most frequently diagnosed malignancy in the United States as well as the second most common cause of cancer death. The five-year survival rate for patients with colorectal cancer detected in an early localized stage is 92%; unfortunately, only 37% of colorectal cancer is diagnosed at this stage. The survival rate drops to 64% if the cancer is allowed to spread to adjacent organs or lymph nodes, and to 7% in patients with distant metastases.

The prognosis of colon cancer is directly related to the degree of penetration of the tumor through the bowel wall and the presence or absence of nodal involvement, consequently, early detection and treatment are especially important. Currently, diagnosis is aided by the use of screening assays for fecal occult blood, sigmoidoscopy, colonoscopy and double contrast barium enemas. Treatment regimens are determined by the type and stage of the cancer, and include surgery, radiation therapy and/or chemotherapy. Recurrence following surgery (the most common form of therapy) is a major problem and is often the ultimate cause of death. In spite of considerable research into therapies for the disease, colon cancer remains difficult to diagnose and treat. In spite of considerable research into therapies for these and other cancers, colon cancer remains difficult to diagnose and treat effectively. Accordingly, there is a need in the art for improved methods for detecting and treating such cancers. The present invention fulfills these needs and further provides other related advantages.

In spite of considerable research into therapies for these and other cancers, colon cancer remains difficult to diagnose and treat effectively. Accordingly, there is a need in the art for improved methods for detecting and treating such cancers. The present invention fulfills these needs and further provides other related advantages such as other colon diseases.

SUMMARY OF THE INVENTION

The present invention is based on the identification of certain cell surface proteins (including shed proteins and secreted proteins) or cytosolic proteins that are differentially expressed in colon cancer. A malignant cell often differs from a normal cell by a differential expression of one or more proteins. These differentially expressed proteins, and the fragments thereof, are important markers for the diagnosis of colon disease. The differentially expressed proteins of the present invention and the nucleic acids encoding said proteins and the fragments of said proteins are referred to herein as colon cancer associated target, CCAT proteins or CCAT nucleic acids or CCAT peptides, respectively.

The present invention provides peptides and protein differentially expressed in colon diseases (hereinafter CCAT). Based on the site of protein localization, e.g., surface or cytosolic, and protein characterization, e.g. receptor or enzyme, specific uses of these CCATs are provided. Some of the CCATs of the present invention serve as targets for one or more classes of therapeutic agents, while others may be suitable for antibody therapeutics.

Accordingly, the present invention provides a method for diagnosing or detecting colon disease in a subject comprising: determining the level of one or more CCAT proteins, or any fragment(s) thereof, in a test sample from said subject, wherein said CCAT protein comprises a sequence selected from a group consisting of SEQ ID NOS: 1-683; wherein a differential level of said CCAT protein(s) or fragment(s) in said sample relative to the level of said protein(s) or fragment(s) in a test sample from a healthy subject, or the level established for a healthy subject, is indicative of colon disease.

The present invention also provides a method for detecting colon cancer in a subject comprising: determining the level of one or more CCAT peptide(s) comprising a peptide sequence selected from a group consisting of SEQ ID NOS: 1332-1501 in a test sample from said subject, wherein a differential level of said CCAT peptide(s) in said sample to the level of said CCAT peptide(s) in a test sample from a healthy subject, or the level of said CCAT peptide(s) established for a healthy subject, is indicative of colon disease.

The present invention further provides a method for detecting colon disease in a subject comprising: determining the level of one or more CCAT nucleic acid(s), or any fragment(s) thereof, in a test sample from said subject, wherein said CCAT nucleic acid(s) encode a CCAT protein sequence selected from a group consisting of SEQ ID NOS: 1-683; wherein a differential level of said CCAT nucleic acids or fragment(s) in said sample relative to the level of said protein(s) or fragment(s) in a test sample from a healthy subject, or the level established for a healthy subject, is indicative of colon disease.

The invention also provides methods for detecting the CCAT peptides, gene or mRNA in a test sample for use in diagnosing the presence, absence or progression of a disease. The test sample includes but is not limited to a biological sample such as tissue, blood, serum or biological fluid.

The present invention further provides a purified antibody that binds specifically to a protein molecule, or any fragment thereof, selected from a group consisting of SEQ ID NOS: 1-683.

The present invention further provides a composition comprising an antibody that binds to a protein selected from a group consisting of SEQ ID NOS: 1-682 and 683, and an acceptable carrier.

The present invention further provides a method for treating colon disease, comprising administering to a patient in need of said treatment a therapeutically effective amount of one or more antibody(ies) of this invention.

The present invention further provides a method for treating colon disease comprising (i) identifying a subject having colon disease and (ii) administering to a said patient a therapeutically effective amount of one or more antibody(ies) of this invention.

The present invention further provides a method to screen for agents that modulate CCAT protein activity, comprising the steps of (i) contacting a test agent with a CCAT protein and (ii) assaying for CCAT protein activity, wherein a change in said activity in the presence of said agent relative to CCAT protein activity in the absence of said agent indicates said agent modulates said CCAT protein activity.

The present invention further provides a method to screen for agents that bind to CCAT protein, comprising the steps of (i) contacting a test agent with a CCAT protein and (ii) measuring the level of binding of agent to said CCAT protein.

The invention also provides diagnostic methods for human disease, in particular for colon diseases, its metastatic stage, and therapeutic potential.

The present invention further provides therapeutic potential for epithelial-cell related cancers. In particular pancreas, lung, colon, prostate, ovarian, breast, bladder renal, hepatocellular, pharyngeal and gastric cancers.

Description of the Files Contained on the CD-R Named CL001515CDR

The CD-R named CL001515CDR contains the following two text (ASCII) files:

1) File SEQLIST__1515 txt provides the Sequence Listing. The Sequence Listing provides the protein sequences (SEQ ID NOS: 1-683); transcript sequences (SEQ ID NOS: 684-1331) and peptide sequences (SEQ ID NOS: 1332-1501) as shown in Table 1. File SEQLIST__1515.txt is 5,852 KB in size and was created on Mar. 18, 2005.

2) File TABLE1__1515.txt provides Table 1. File TABLE1__1515.txt is 165 KB in size and was created on Feb. 15, 2007.

TABLES

The patent contains table(s) that have been included at the end of the specification.

The present invention further provides diagnostic method for epithelial-cell related cancers. In particular, pancreas, lung, colon, prostate, ovarian, breast, bladder renal, hepatocellular, pharyngeal, and gastric cancers.

The invention also provides a method for monitoring the disease progression and the treatment progress.

The invention further provide a method of diagnosis by an array, wherein the array is immobilized with two or more CCAT proteins, peptides or nucleic acid molecules. The proteins, peptides or nucleic acid molecules include but are not limited to the SEQ ID NOS: 1-1501.

The invention also provides monoclonal or polyclonal antibodies and composition thereof reactive with antigenic portion of CCAT protein, peptides or fragments thereof in a form for use in colon disease diagnosis.

The invention further provides an immunogenic antibody for treating colon diseases disease or diseases associated with colon diseases.

The present invention provides a method for screening agents that modulate CCAT activity, comprising the steps of (a) contacting a sample comprising CCAT with an agent; and (b) assaying for CCAT activity, wherein a change in said CCAT activity in the presence of said agent relative to CCAT activity in the absence of said compound indicates said agent modulates CCAT. The agents include but are not limited to protein, peptide, antibody, nucleic acid such as antisense RNA, RNAi fragments, small molecules.

The present invention further provides a method for treating colon diseases, comprising: administering to a patient with one or more agents in a therapeutically effective amount to treat colon diseases.

The present invention provides a method for treating colon diseases, comprising: identifying a subject having colon diseases; and administering to a patient to one or more antibodies in a therapeutically effective amount to treat colon diseases.

The present invention further provide method for diagnosis and treatment for colon cancer.

The material contained on the CD-R labeled CL001515 CDR is hereby incorporated by reference pursuant to 37 CFR 1.77(b)(4).

Description of Table 1

Table 1 (provided on the CD-R) discloses the peptides which correspond to the protein in the colon cancer tumor tissues ("source"), the expression information, and the ratio compare to the control sample. The expression is based on measuring the level of the peptides. The ratio represents the number of overexpression by more than two, and numerical representation of overexpression is also indicated. "Singleton" indicates that the peptide peak in diseased sample was detected and there was no peak detected in control samples.

Table 1 also discloses the CCAT proteins, transcripts, and peptides sequences.

The transcript/protein information includes:

a protein number (1 through 683)

a Celera protein internal identification number for the protein encoded by the Celera transcript (hCP and/or UID)

a public protein accession number (Genbank e.g., RefSeq NP number, Swiss-prot, or Derwent) for the protein an art-known gene/protein name a Celera transcript internal identification number (hCT and/or UID)

a public transcript accession number (Genbank e.g., RefSeq NM number, or Derwent)

a Celera hCG and UID internal identification numbers for the gene an art-known gene symbol Celera genomic axis position (indicating start nucleotide position-stop nucleotide position)

the chromosome number of the chromosome on which the gene is located an OMIM (Online Mendelian Inheritance in Man; Johns Hopkins University/NCBI) public reference number for obtaining further information regarding the medical significance of each gene alternative gene/protein name(s) and/or symbol(s) in the OMIM entry

DETAILED DESCRIPTION OF THE PREFERRED EMBODIMENTS

General Description

Figure 1:
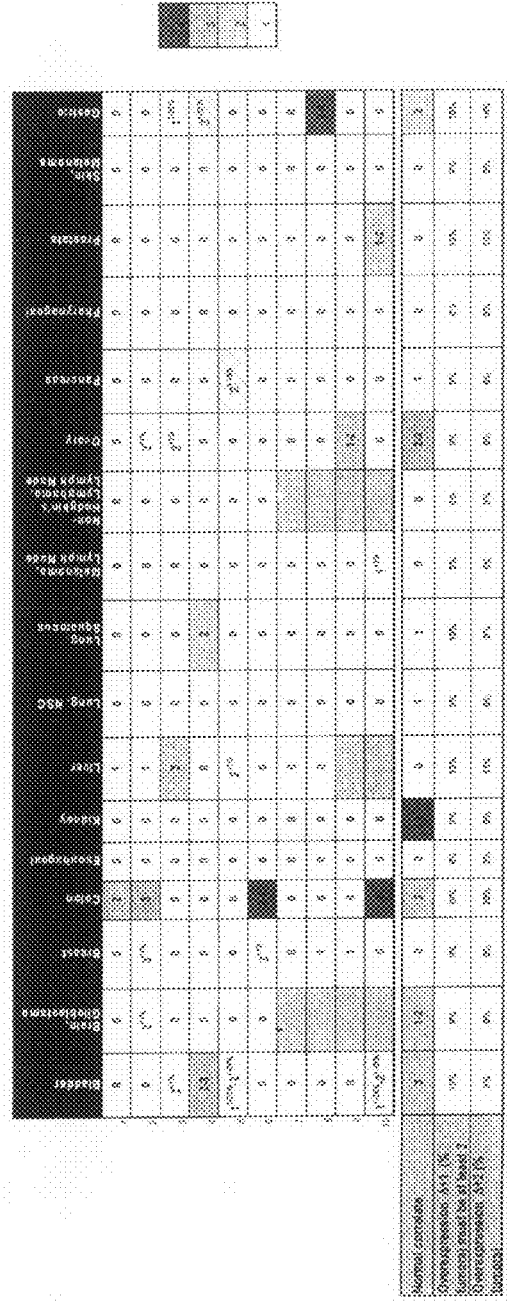
FIG. 1. DPEP-1 expression in various tumor types by immunohistochemistry.
Figure 2:
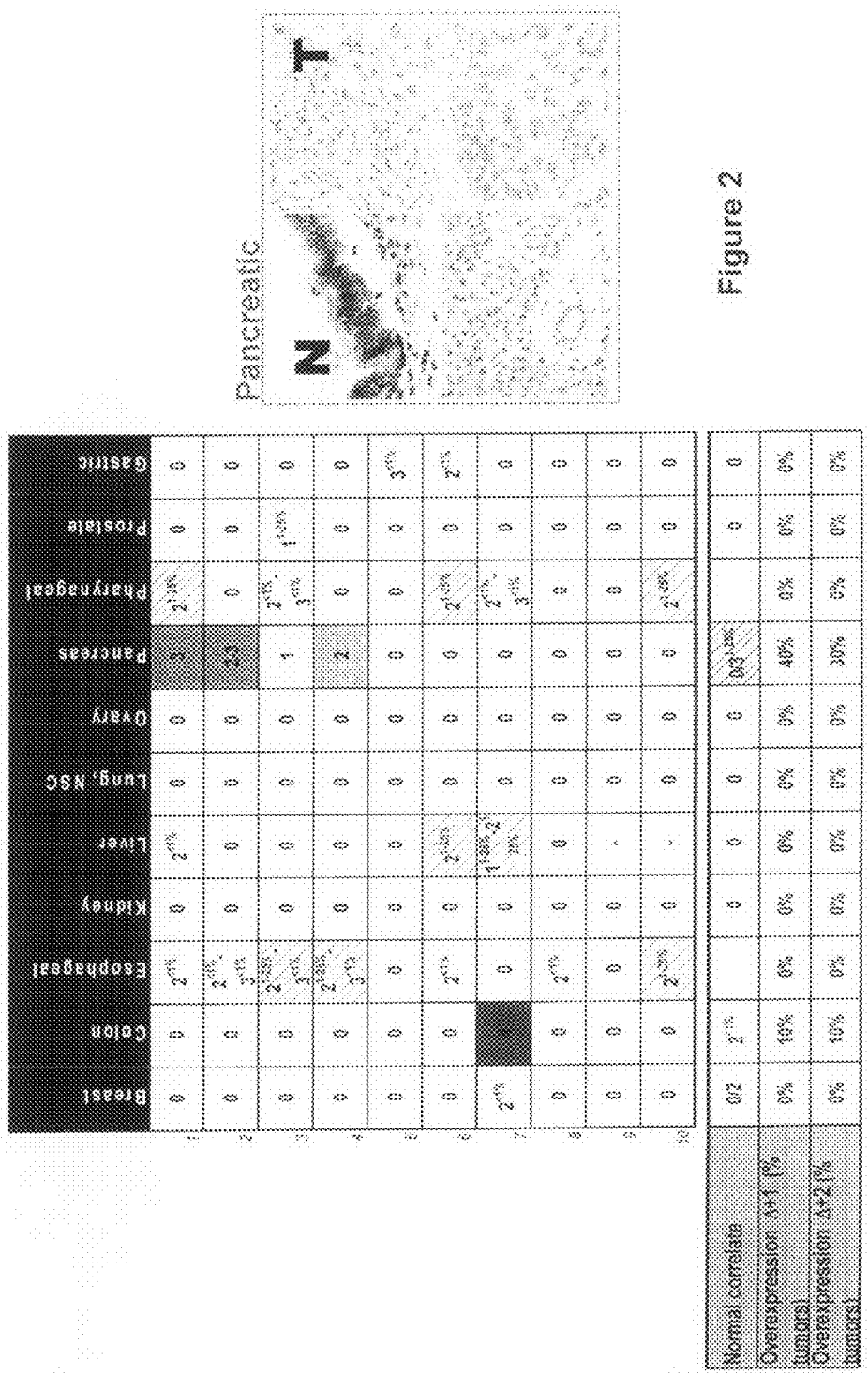
FIG. 2. Integrin Beta-4 expression in various tumor types by immunohistochemistry.

While the broadest definition of this invention is set forth in the Summary of the Invention, certain nucleic acids, peptides or proteins are preferred. For example a preferred method for detecting colon disease by determining the level of one or more CCAT protein(s) or any fragment(s) thereof is wherein the level of CCAT protein(s) are determined by contacting one or more antibody(ies) that specifically bind to the antigenic regions of the CCAT protein(s). Further preferred is a method wherein the level of two or more proteins are determined, more preferred wherein the level of four or more proteins are determined and most preferred wherein the level of eight or more proteins are determined.

A preferred method for detecting colon disease by determining the level of one or more CCAT peptide(s) is wherein the level of CCAT peptides(s) are determined by contacting one or more antibody(ies) that specifically bind to the antigenic regions of the CCAT peptide(s). Further preferred is a method wherein the level of five or more peptides are determined, more preferred wherein the level of ten or more peptides are determined and most preferred wherein the level of fifteen or more peptides are determined.

A preferred method for detecting colon disease by determining the level of one or more CCAT nucleic acid(s) is wherein the level of said CCAT nucleic acid(s) is determined by contacting one or more probes that specifically hybridize to said nucleic acid(s). Further preferred is a method wherein the level of two or more nucleic acids are determined, more preferred wherein the level of four or more nucleic acids are determined and most preferred wherein the level of eight or more nucleic acids are determined.

The methods for detecting colon disease provided by the present invention may be used for diagnosing the presence of disease in a patent, monitoring the presence of colon disease in patients undergoing treatment and testing for the reoccurrence of colon disease in patients that were successfully treated for colon disease; preferably wherein the colon disease is colon cancer. The test sample may be, but is not limited to, a biological sample such as tissue, blood, serum or biological fluid.

The present invention is based on the discovery of protein (s) and peptide(s) that are differentially expressed in colon cancer samples versus normal colon diseases samples. These proteins and peptide, and the encoding nucleic acid molecules are associated with colon diseases, hereinafter the CCAT protein, peptide or nucleic acids.

The discovery of disease specific target proteins is base on discoveries made using proteomics techniques. The method uses on MALDI-TOF TOF LC/MS analyses platform to generate protein expression profiles from colon diseases tissues or cell lines in an effort to discover and identify novel molecules associated with the disease.

Based on these discoveries, the present invention provides proteins, peptides, nucleic acids that are differential in colon diseases, as well as antibodies binds to the proteins or peptides. The present invention also provides methods for detection, monitoring, diagnosis, prognosis, preventive and treatment of colon diseases. The present invention provides a detection reagent, markers for colon diseases at various stages, comprises CCAT sequences isolated from human colon disease tissue, sera, cell lines, blood or biological fluids.

The present invention provides a method for treating colon diseases targeting at CCAT. The treatment includes administration of a therapeutically effective amount of composition comprise, but not limit to, an antibody, an immunogenic peptide which induces T cell response, a small molecule, a protein or a nucleic acid molecule. The composition further comprises an agonist or antagonist to CCAT. A "colon or colorectal disease" includes but not limited to colon cancer, colon tumor, diverticulosis, diverticulitis, Crohn's disease, ulcerative colitis, irritable bowel syndrome, inflammatory bowel disease, hemorrhoids, and anal fissure.

The present invention may further provide a diagnostic or therapeutic potential for epithelial-cell related cancers, which include but are not limited to pancreas, lung, colon, prostate, ovarian, breast, bladder renal, hepatocellular, pharyngeal and gastric cancers.

The present invention further provides the target for screening an agent for CCAT, wherein the agent is compounds of small molecules, proteins, peptides, nucleic acids, antibodies or other agonists or antagonists.

CCAT Peptide/Proteins and Peptides

The present invention provides isolated CCAT peptide and protein molecules that consisting of, consisting essentially of, or comprising the amino acid sequences of the CCAT peptides and proteins disclosed in Table 1, as well as all obvious variants of these peptides that are within the art to make and use. Some of these variants are described in detail below.

In one embodiment CCAT peptides include, but are not limited to, the amino acid sequence of SEQ ID NOS: 1332-1501 and variants thereof. A CCAT protein includes, but is not limited to, the amino acid sequences of SEQ ID NOS: 1-683 and variants thereof. CCAT proteins may be differentially expressed in colon cell line, blood, tissue, serum or body fluids.

The peptide or protein or fragment thereof, to which the invention pertains, however, are not to be construed as encompassing peptide, protein or fragment that may be disclosed publicly prior to the present invention.

The CCAT proteins and peptides of the present invention can be purified to homogeneity or other degrees of purity. The level of purification will be based on the intended use. The critical feature is that the preparation allows for the desired function of the peptide, even if in the presence of considerable amounts of other components (the features of an isolated nucleic acid molecule is discussed below).

As used herein, a "peptide" is defined as amino acid sequences between 5-20 amino acids derived from CCAT proteins such as SEQ ID NOS: 1-683 or variants thereof. The peptide differentially expressed in either colon disease cell line, blood, tissue, serum or body fluids. In one embodiment peptides include, but are not limited to, the amino acid sequence of SEQ ID NOS: 1332-1501, or variants thereof.

As used herein, a "protein" is full-length protein differentially expressed in colon disease cell line, tissue, blood, serum or body fluids. A protein includes, but is not limited to, the amino acid sequences sequence of SEQ ID NOS: 1-683.

A peptide is said to be "isolated" or "purified" when it is substantially free of cellular material or free of chemical precursors or other chemicals. The peptides of the present invention can be purified to homogeneity or other degrees of purity. The level of purification will be based on the intended use. The critical feature is that the preparation allows for the desired function of the peptide, even if in the presence of considerable amounts of other components (the features of an isolated nucleic acid molecule are discussed below).

In some uses, "substantially free of cellular material" includes preparations of the peptide having less than about 30% (by dry weight) other proteins (i.e., contaminating protein), less than about 20% other proteins, less than about 10% other proteins, or less than about 5% other proteins. When the peptide is recombinantly produced, it can also be substantially free of culture medium, i.e., culture medium represents less than about 20% of the volume of the protein preparation.

The language "substantially free of chemical precursors or other chemicals" includes preparations of the peptide in which it is separated from chemical precursors or other chemicals that are involved in its synthesis. In one embodiment, the language "substantially free of chemical precursors or other chemicals" includes preparations of the CCAT peptide having less than about 30% (by dry weight) chemical precursors or other chemicals, less than about 20% chemical precursors or other chemicals, less than about 10% chemical precursors or other chemicals, or less than about 5% chemical precursors or other chemicals.

The isolated CCAT proteins and peptide can be purified from cells that naturally express it, purified from cells that have been altered to express it (recombinant), or synthesized using known protein synthesis methods. Sambrook et al., Molecular Cloning: A Laboratory Manual. 3rd. ed., Cold Spring Harbor Laboratory Press, Cold Spring Harbor, N.Y., (2001). Experimental data as provided in Table 1 indicates expression in human colon tumor tissues. For example, a nucleic acid molecule encoding the CCAT protein or peptide is cloned into an expression vector, the expression vector introduced into a host cell and the protein expressed in the host cell. The protein or peptide can then be isolated from the cells by an appropriate purification scheme using standard protein purification techniques. Many of these techniques are described in detail below.

A CCAT peptide or protein can be attached to heterologous sequences to form chimeric or fusion proteins. Such Schimeric and fusion proteins comprise a peptide operatively linked to a heterologous protein having an amino acid sequence not substantially homologous to the peptide. "Operatively linked" indicates that the peptide and the heterologous protein are fused in-frame. The heterologous protein can be fused to the N-terminus or C-terminus of the peptide.

In some uses, the fusion protein does not affect the activity of the peptide or protein per se. For example, the fusion protein can include, but is not limited to, fusion proteins, for example beta-galactosidase fusions, yeast two-hybrid GAL fusions, poly-His fusions, MYC-tagged, HI-tagged and Ig fusions. Such fusion proteins, particularly poly-His fusions, can facilitate the purification of recombinant CCAT proteins or peptides. In certain host cells (e.g., mammalian host cells), expression and/or secretion of a protein can be increased by using a heterologous signal sequence.

A chimeric or fusion CCAT protein or peptide can be produced by standard recombinant DNA techniques. For example, DNA fragments coding for the different protein sequences are ligated together in-frame in accordance with conventional techniques. In another embodiment, the fusion gene can be synthesized by conventional techniques including automated DNA synthesizers. Alternatively, PCR amplification of gene fragments can be carried out using anchor primers which give rise to complementary overhangs between two consecutive gene fragments which can subsequently be annealed and re-amplified to generate a chimeric gene sequence (see Ausubel et al., Current Protocols in Molecular Biology, 1992). Moreover, many expression vectors are commercially available that already encode a fusion moiety (e.g., a GST protein). A CCAT-encoding nucleic acid can be cloned into such an expression vector such that the fusion moiety is linked in-frame to the CCAT protein or peptide.

As mentioned above, the CCAT peptide or the CCAT protein has obvious variants of the amino acid sequence, such as naturally occurring mature forms of the CCAT, allelic/sequence variants of the CCAT, non-naturally occurring recombinantly derived variants of the CCATs, and orthologs and paralogs of the CCAT proteins or peptides. Such variants can readily be generated using art-known techniques in the fields of recombinant nucleic acid technology and protein biochemistry.

It is understood, however, that CCAT and variants exclude any amino acid sequences disclosed prior to the invention.

Such variants can readily be identified/made using molecular techniques and the sequence information disclosed herein. Further, such variants can readily be distinguished from other peptides based on sequence and/or structural homology to the CCAT peptides of the present invention. The degree of homology/identity present will be based primarily on whether the peptide is a functional variant or non-functional variant, the amount of divergence present in the paralog family and the evolutionary distance between the orthologs.

To determine the percent identity of two amino acid sequences or two nucleic acid sequences, the sequences are aligned for optimal comparison purposes (e.g., gaps can be introduced in one or both of a first and a second amino acid or nucleic acid sequence for optimal alignment and non-homologous sequences can be disregarded for comparison purposes). In a preferred embodiment, at least 30%, 40%, 50%, 60%, 70%, 80%, or 90% or more of the length of a reference sequence is aligned for comparison purposes. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein amino acid or nucleic acid "identity" is equivalent to amino acid or nucleic acid "homology"). The percent identity between the two sequences is a function of the number of identical positions shared by the sequences, taking into account the number of gaps, and the length of each gap, which need to be introduced for optimal alignment of the two sequences.

The comparison of sequences and determination of percent identity and similarity between two sequences can be accomplished using a mathematical algorithm. (Computational Molecular Biology, Lesk, A. M., ed., Oxford University Press, New York, 1988; Biocomputing: Informatics and Genome Projects, Smith, D. W., ed., Academic Press, New York, 1993; Computer Analysis of Sequence Data, Part 1, Griffin, A. M., and Griffin, H. G., eds., Humana Press, New Jersey, 1994; Sequence Analysis in Molecular Biology, von Heinje, G., Academic Press, 1987; and Sequence Analysis Primer, Gribskov, M. and Devereux, J., eds., M Stockton Press, New York, 1991). In a preferred embodiment, the percent identity between two amino acid sequences is determined using the Needleman and Wunsch (J. Mol. Biol. (48): 444-453 (1970)) algorithm which has been incorporated into the GAP program in the GCG software package, using either a Blossom 62 matrix or a PAM250 matrix, and a gap weight of 16, 14, 12, 10, 8, 6, or 4 and a length weight of 1, 2, 3, 4, 5, or 6. In yet another preferred embodiment, the percent identity between two nucleotide sequences is determined using the GAP program in the GCG software package (Devereux, J., et al., Nucleic Acids Res. 12(1):387 (1984)), using a NWS-gapdna.CMP matrix and a gap weight of 40, 50, 60, 70, or 80 and a length weight of 1, 2, 3, 4, 5, or 6. In another embodiment, the percent identity between two amino acid or nucleotide sequences is determined using the algorithm of E. Myers and W. Miller (CABIOS, 4:11-17 (1989)) which has been incorporated into the ALIGN program (version 2.0), using a PAM120 weight residue table, a gap length penalty of 12 and a gap penalty of 4.

The nucleic acid and protein sequences of the present invention can further be used as a "query sequence" to perform a search against sequence databases to, for example, identify other family members or related sequences. Such searches can be performed using the NBLAST and XBLAST programs (version 2.0) of Altschul, et al. (J. Mol. Biol. 215: 403-10 (1990)). BLAST nucleotide searches can be performed with the NBLAST program, score=100, wordlength=12 to obtain nucleotide sequences homologous to the nucleic acid molecules of the invention. BLAST protein searches can be performed with the XBLAST program, score=50, wordlength=3 to obtain amino acid sequences homologous to the proteins of the invention. To obtain gapped alignments for comparison purposes, Gapped BLAST can be utilized as described in Altschul et al. (Nucleic Acids Res. 25(17):3389-3402 (1997)). When utilizing BLAST and gapped BLAST programs, the default parameters of the respective programs (e.g., XBLAST and NBLAST) can be used.

Full-length pre-processed forms, as well as mature processed forms, of proteins that comprise one of the peptides of the present invention can readily be identified as having complete sequence identity to one of the CCAT peptides of the present invention as well as being encoded by the same genetic locus as the CCAT peptide provided herein.

Allelic variants of a CCAT peptide can readily be identified as being a human protein having a high degree (significant) of sequence homology/identity to at least a portion of the CCAT peptide as well as being encoded by the same genetic locus as the CCAT peptide provided herein. Genetic locus can readily be determined based on the genomic information provided in Table 1, such as the genomic sequence mapped to the reference human. As used herein, two proteins (or a region of the proteins) have significant homology when the amino acid sequences are typically at least about 70-80%, 80-90%, and more typically at least about 90-95% or more homologous. A significantly homologous amino acid sequence, according to the present invention, will be encoded by a nucleic acid sequence that will hybridize to a CCAT peptide encoding nucleic acid molecule under stringent conditions as more fully described below.

Paralogs of a CCAT peptide can readily be identified as having some degree of significant sequence homology/identity to at least a portion of the CCAT peptide, as being encoded by a gene from humans, and as having similar activity or function. Two proteins will typically be considered paralogs when the amino acid sequences are typically at least about 60% or greater, and more typically at least about 70% or greater homology through a given region or domain. Such paralogs will be encoded by a nucleic acid sequence that will hybridize to a CCAT peptide encoding nucleic acid molecule under moderate to stringent conditions as more fully described below.

Orthologs of a CCAT peptide can readily be identified as having some degree of significant sequence homology/identity to at least a portion of the CCAT peptide as well as being encoded by a gene from another organism. Preferred orthologs will be isolated from mammals, preferably primates, for the development of human therapeutic targets and agents. Such orthologs will be encoded by a nucleic acid sequence that will hybridize to a CCAT peptide encoding nucleic acid molecule under moderate to stringent conditions, as more fully described below, depending on the degree of relatedness of the two organisms yielding the proteins.

Non-naturally occurring variants of the CCAT peptides of the present invention can readily be generated using recombinant techniques. Such variants include, but are not limited to deletions, additions and substitutions in the amino acid sequence of the CCAT peptide. For example, one class of substitutions is conserved amino acid substitution. Such substitutions are those that substitute a given amino acid in a CCAT peptide by another amino acid of like characteristics. Typically seen as conservative substitutions are the replacements, one for another, among the aliphatic amino acids Ala, Val, Leu, and Ile; interchange of the hydroxyl residues Ser and Thr; exchange of the acidic residues Asp and Glu; substitution between the amide residues Asn and Gln; exchange of the basic residues Lys and Arg; and replacements among the aromatic residues Phe and Tyr. Guidance concerning which amino acid changes are likely to be phenotypically silent are found in Bowie et al., Science 247:1306-1310 (1990).

Variant CCAT peptides can be fully functional or can lack function in one or more activities, e.g. ability to bind substrate, ability to phosphorylate substrate, ability to mediate signaling, etc. Fully functional variants typically contain only conservative variation or variation in non-critical residues or in non-critical regions.

Non-functional variants typically contain one or more non-conservative amino acid substitutions, deletions, insertions, inversions, or truncation or a substitution, insertion, inversion, or deletion in a critical residue or critical region.

Amino acids that are essential for function can be identified by methods known in the art, such as site-directed mutagenesis or alanine-scanning mutagenesis (Cunningham et al., Science 244:1081-1085 (1989)). The latter procedure introduces single alanine mutations at every residue in the molecule. The resulting mutant molecules are then tested for biological activity such as CCAT activity or in assays such as an in vitro proliferative activity. Sites that are critical for binding partner/substrate binding can also be determined by structural analysis such as crystallization, nuclear magnetic resonance or photoaffinity labeling (Smith et al., J. Mol. Biol. 224:899-904 (1992); de Vos et al. Science 255:306-312 (1992)).

The present invention further provides fragments of the CCATs, in addition to proteins and peptides that comprise and consist of such fragments, particularly those comprising the residues identified in Table 1. As used herein, a fragment comprises at least 8, 10, 12, 14, 16, 18, 20 or more contiguous amino acid residues from a CCAT. Such fragments can be chosen based on the ability to retain one or more of the biological activities of the CCAT or could be chosen for the ability to perform a function, e.g. bind a substrate or act as an immunogen. Particularly important fragments are biologically active fragments, peptides that are, for example, about 8 or more amino acids in length. Such fragments will typically comprise a domain or motif of the CCAT, e.g., active site, a transmembrane domain or a substrate-binding domain. Further, possible fragments include, but are not limited to, domain or motif containing fragments, soluble peptide fragments, and fragments containing immunogenic structures. Predicted domains and functional sites are readily identifiable by computer programs well known and readily available to those of skill in the art (e.g., PROSITE analysis).

Polypeptides often contain amino acids other than the 20 amino acids commonly referred to as the 20 naturally occurring amino acids. Further, many amino acids, including the terminal amino acids, may be modified by natural processes, such as processing and other post-translational modifications, or by chemical modification techniques well known in the art. Common modifications that occur naturally in CCATs are described in basic texts, detailed monographs, and the research literature, and they are well known to those of skill in the art.

Known modifications include, but are not limited to, acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of phosphotidylinositol, cross-linking, cyclization, disulfide bond formation, demethylation, formation of covalent crosslinks, formation of cystine, formation of pyroglutamate, formylation, gamma carboxylation, glycosylation, GPI anchor formation, hydroxylation, iodination, methylation, myristoylation, oxidation, proteolytic processing, phosphorylation, prenylation, racemization, selenoylation, sulfation, transfer-RNA mediated addition of amino acids to proteins such as arginylation, and ubiquitination.

Such modifications are well known to those of skill in the art and have been described in great detail in the scientific literature. Several particularly common modifications, glycosylation, lipid attachment, sulfation, gamma-carboxylation of glutamic acid residues, hydroxylation and ADP-ribosylation, for instance, are described in most basic texts, such as Proteins—Structure and Molecular Properties, 2nd Ed., T. E. Creighton, W. H. Freeman and Company, New York (1993). Many detailed reviews are available on this subject, such as by Wold, F., Posttranslational Covalent Modification of Proteins, B.C. Johnson, Ed., Academic Press, New York 1-12 (1983); Seifter et al. (Meth. Enzymol. 182: 626-646 (1990)) and Rattan et al. (Ann. N.Y. Acad. Sci. 663:48-62 (1992)).

Accordingly, the CCATs of the present invention also encompass derivatives or analogs in which a substituted amino acid residue is not one encoded by the genetic code, in which a substituent group is included, in which the mature CCAT is fused with another compound, such as a compound to increase the half-life of the CCAT (for example, polyethylene glycol), or in which the additional amino acids are fused to the mature CCAT, such as a leader or secretory sequence or a sequence for purification of the mature CCAT or a pro-protein sequence.

Protein/Peptide Uses

The proteins of the present invention can be used in substantial and specific assays related to the functional information provided in Table 1; to raise antibodies or to elicit another immune response; as a reagent (including the labeled reagent) in assays designed to quantitatively determine levels of the protein (or its binding partner or ligand) in biological fluids; and as markers for tissues in which the corresponding protein is preferentially expressed (either constitutively or at a particular stage of tissue differentiation or development or in a disease state). Where the protein binds or potentially binds to another protein or ligand (such as, for example, in a CCAT-effector protein interaction or CCAT-ligand interaction), the protein can be used to identify the binding partner/ligand so as to develop a system to identify inhibitors of the binding interaction. Any or all of these uses are capable of being developed into reagent grade or kit format for commercialization as commercial products.

Methods for performing the uses listed above are well known to those skilled in the art. References disclosing such methods include "Molecular Cloning: A Laboratory Manual", $3^{rd}$. ed., Cold Spring Harbor Laboratory Press, Sambrook, J., E. F. Fritsch and T. Maniatis eds., 2001, and "Methods in Enzymology: Guide to Molecular Cloning Techniques", Academic Press, Berger, S. L. and A. R. Kimmel eds., 1987.

The potential uses of the peptides of the present invention are based primarily on the source of the protein as well as the class/action of the protein. For example, CCATs isolated from humans and their human/mammalian orthologs serve as targets for identifying agents for use in mammalian therapeutic applications, e.g. a human drug, particularly in modulating a biological or pathological response in a cell or tissue that expresses the CCAT. Experimental data as provided in Table 1 indicate that the CCAT of the present invention are overexpressed in colon tumor tissue. A large percentage of pharmaceutical agents are being developed that modulate the activity of CCAT proteins, particularly members of the CCAT subfamily (see Background of the Invention). The structural and functional information provided in the Background and Figures provide specific and substantial uses for the molecules of the present invention, particularly in combination with the expression information provided in Table 1. Experimental data as provided in Table 1 indicates expression in human colon tumor tissues. Such uses can readily be determined using the information provided herein, that which is known in the art, and routine experimentation.

The proteins of the present invention (including variants and fragments that may have been disclosed prior to the present invention) are useful for biological assays related to CCATs that are related to members of the CCAT subfamily. Such assays involve any of the known CCAT functions or activities or properties useful for diagnosis and treatment of CCAT-related conditions that are specific for the subfamily of CCATs that the one of the present invention belongs to, particularly in cells and tissues that express the CCAT. Experimental data as provided in Table 1 indicate that the CCAT of the present invention are overexpressed in colon tumor tissue The proteins of the present invention are also useful in drug screening assays, in cell-based or cell-free systems. Cell-based systems can be native, i.e., cells that normally express the CCAT, as a biopsy or expanded in cell culture. Experimental data as provided in Table 1 indicates expression in human colon tumor tissues. In an alternate embodiment, cell-based assays involve recombinant host cells expressing the CCAT protein.

The polypeptides can be used to identify compounds or agents that modulate CCAT activity of the protein in its natural state or an altered form that causes a specific disease or pathology associated with the CCAT. Both the CCATs of the present invention and appropriate variants and fragments can be used in high-throughput screens to assay candidate compounds for the ability to bind to the CCAT. These compounds can be further screened against a functional CCAT to determine the effect of the compound on the CCAT activity. Further, these compounds can be tested in animal or invertebrate systems to determine activity/effectiveness. Compounds can be identified that activate (agonist) or inactivate (antagonist) the CCAT to a desired degree.

Further, the proteins of the present invention can be used to screen a compound or an agent for the ability to stimulate or inhibit interaction between the CCAT protein and a molecule that normally interacts with the CCAT protein, e.g. a substrate or or an extracellular binding ligand or a component of the signal pathway that the CCAT protein normally interacts (for example, a cytosolic signal protein or another CCAT). Such assays typically include the steps of combining the CCAT protein with a candidate compound under conditions that allow the CCAT protein, or fragment, to interact with the target molecule, and to detect the formation of a complex between the protein and the target or to detect the biochemical consequence of the interaction with the CCAT protein and the target, such as any of the associated effects of signal transduction such as protein phosphorylation, cAMP turnover, and adenylate cyclase activation, etc.

Candidate compounds or agents include, for example, 1) peptides such as soluble peptides, including Ig-tailed fusion peptides and members of random peptide libraries (see, e.g., Lam et al., Nature 354:82-84 (1991); Houghten et al., Nature 354:84-86 (1991)) and combinatorial chemistry-derived molecular libraries made of D- and/or L-configuration amino acids; 2) phosphopeptides (e.g., members of random and partially degenerate, directed phosphopeptide libraries, see, e.g., Songyang et al., Cell 72:767-778 (1993)); 3) antibodies (e.g., polyclonal, monoclonal, humanized, anti-idiotypic, chimeric, and single chain antibodies as well as Fab, F(ab')2, Fab expression library fragments, and epitope-binding fragments of antibodies); and 4) small organic and inorganic molecules (e.g., molecules obtained from combinatorial and natural product libraries).

One candidate compound or agent is a soluble fragment of the CCAT that competes for substrate binding. Other candidate compounds include mutant CCATs or appropriate fragments containing mutations that affect CCAT function and thus compete for substrate. Accordingly, a fragment that competes for substrate, for example with a higher affinity, or a fragment that binds substrate but does not allow release, is encompassed by the invention.

The invention further includes other end point assays to identify compounds that modulate (stimulate or inhibit) CCAT activity. The assays typically involve an assay of events in the signal transduction pathway that indicate CCAT activity. Thus, the phosphorylation of a substrate, activation of a protein, a change in the expression of genes that are up- or down-regulated in response to the CCAT protein dependent signal cascade can be assayed.

Any of the biological or biochemical functions mediated by the CCAT can be used as an endpoint assay. These include all of the biochemical or biochemical/biological events described herein, in the references cited herein, incorporated by reference for these endpoint assay targets, and other functions known to those of ordinary skill in the art or that can be readily identified using the information provided in Table 1. Specifically, a biological function of a cell or tissues that expresses the CCAT can be assayed. Experimental data as provided in Table 1 indicate that the CCAT of the present invention are overexpressed in colon tumor tissue.

Binding and/or activating compounds can also be screened by using chimeric CCAT proteins in which the amino terminal extracellular domain, or parts thereof, the entire transmembrane domain or subregions, such as any of the seven transmembrane segments or any of the intracellular or extracellular loops and the carboxy terminal intracellular domain, or parts thereof, can be replaced by heterologous domains or subregions. For example, a substrate-binding region can be used that interacts with a different substrate then that which is recognized by the native CCAT. Accordingly, a different set of signal transduction components is available as an endpoint assay for activation. This allows for assays to be performed in other than the specific host cell from which the CCAT is derived.

The proteins of the present invention are also useful in competition binding assays in methods designed to discover compounds that interact with the CCAT (e.g. binding partners and/or ligands). Thus, a compound is exposed to a CCAT polypeptide under conditions that allow the compound to bind or to otherwise interact with the polypeptide. Soluble CCAT polypeptide is also added to the mixture. If the test compound interacts with the soluble CCAT polypeptide, it decreases the amount of complex formed or activity from the CCAT. This type of assay is particularly useful in cases in which compounds are sought that interact with specific regions of the CCAT. Thus, the soluble polypeptide that competes with the target CCAT region is designed to contain peptide sequences corresponding to the region of interest.

To perform cell free drug screening assays, it is sometimes desirable to immobilize either the CCAT protein, or fragment, or its target molecule to facilitate separation of complexes from uncomplexed forms of one or both of the proteins, as well as to accommodate automation of the assay.

Techniques for immobilizing proteins on matrices can be used in the drug screening assays. In one embodiment, a fusion protein can be provided which adds a domain that allows the protein to be bound to a matrix. For example, glutathione-S-transferase fusion proteins can be adsorbed onto glutathione sepharose beads (Sigma Chemical, St. Louis, Mo.) or glutathione derivatized microtitre plates, which are then combined with the cell lysates (e.g., $^{35}$S-labeled) and the candidate compound, and the mixture incubated under conditions conducive to complex formation (e.g., at physiological conditions for salt and pH). Following incubation, the beads are washed to remove any unbound label, and the matrix immobilized and radiolabel determined directly, or in the supernatant after the complexes are dissociated. Alternatively, the complexes can be dissociated from the matrix, separated by SDS-PAGE, and the level of CCAT-binding protein found in the bead fraction quantitated from the gel using standard electrophoretic techniques. For example, either the polypeptide or its target molecule can be immobilized utilizing conjugation of biotin and streptavidin using techniques well known in the art. Alternatively, antibodies reactive with the protein but which do not interfere with binding of the protein to its target molecule can be derivatized to the wells of the plate, and the protein trapped in the wells by antibody conjugation. Preparations of a CCAT-binding protein and a candidate compound are incubated in the CCAT protein-presenting wells and the amount of complex trapped in the well can be quantitated. Methods for detecting such complexes, in addition to those described above for the GST-immobilized complexes, include immunodetection of complexes using antibodies reactive with the CCAT protein target molecule, or which are reactive with CCAT protein and compete with the target molecule, as well as CCAT-linked assays which rely on detecting an enzymatic activity associated with the target molecule.

Agents that modulate one of the CCATs of the present invention can be identified using one or more of the above assays, alone or in combination. It is generally preferable to use a cell-based or cell free system first and then confirm activity in an animal or other model system. Such model systems are well known in the art and can readily be employed in this context.

Modulators of CCAT protein activity identified according to these drug screening assays can be used to treat a subject with a disorder mediated by the CCAT pathway, by treating cells or tissues that express the CCAT. Experimental data as provided in Table 1 indicates expression in human colon tumor tissues. These methods of treatment include the steps of administering a modulator of CCAT activity in a pharmaceutical composition to a subject in need of such treatment, the modulator being identified as described herein.

In yet another aspect of the invention, the CCAT proteins can be used as "bait proteins" in a two-hybrid assay or three-hybrid assay (see, e.g., U.S. Pat. No. 5,283,317; Zervos et al. (1993) Cell 72:223-232; Madura et al. (1993) J. Biol. Chem. 268:12046-12054; Bartel et al. (1993) Biotechniques 14:920-924; Iwabuchi et al. (1993) Oncogene 8:1693-1696; and Brent WO94/10300), to identify other proteins, which bind to or interact with the CCAT and are involved in CCAT activity. Such CCAT-binding proteins are also likely to be involved in the propagation of signals by the CCAT proteins or CCAT targets as, for example, downstream elements of a CCAT-mediated signaling pathway. Alternatively, such CCAT-binding proteins are likely to be CCAT inhibitors.

The two-hybrid system is based on the modular nature of most transcription factors, which consist of separable DNA-binding and activation domains. Briefly, the assay utilizes two different DNA constructs. In one construct, the gene that codes for a CCAT protein is fused to a gene encoding the DNA binding domain of a known transcription factor (e.g., GAL-4). In the other construct, a DNA sequence, from a library of DNA sequences that encode an unidentified protein ("prey" or "sample") is fused to a gene that codes for the activation domain of the known transcription factor. If the "bait" and the "prey" proteins are able to interact, in vivo, forming a CCAT-dependent complex, the DNA-binding and activation domains of the transcription factor are brought into close proximity. This proximity allows transcription of a reporter gene (e.g., LacZ) which is operably linked to a transcriptional regulatory site responsive to the transcription factor. Expression of the reporter gene can be detected and cell colonies containing the functional transcription factor can be isolated and used to obtain the cloned gene which encodes the protein which interacts with the CCAT protein.

This invention further pertains to novel agents identified by the above-described screening assays. Accordingly, it is within the scope of this invention to further use an agent identified as described herein in an appropriate animal model. For example, an agent identified as described herein (e.g., a CCAT-modulating agent, an antisense CCAT nucleic acid molecule, an CCAT-RNAi fragment, a CCAT-specific antibody, or a CCAT-binding partner) can be used in an animal or other model to determine the efficacy, toxicity, or side effects of treatment with such an agent. Alternatively, an agent identified as described herein can be used in an animal or other model to determine the mechanism of action of such an agent. Furthermore, this invention pertains to uses of novel agents identified by the above-described screening assays for treatments as described herein.

The CCAT proteins of the present invention are also useful to provide a target for diagnosing a disease or predisposition to disease mediated by the peptide. Accordingly, the invention provides methods for detecting the presence, or levels of, the protein (or encoding mRNA) in a cell, tissue, or organism. Experimental data as provided in Table 1 indicates expression in human colon tumor tissues. The method involves contacting a biological sample with a compound capable of interacting with the CCAT protein such that the interaction can be detected. Such an assay can be provided in a single detection format or a multi-detection format such as an antibody chip array.

One agent for detecting a protein in a sample is an antibody capable of selectively binding to protein. A biological sample includes tissues, cells and biological fluids isolated from a subject, as well as tissues, cells and fluids present within a subject.

The peptides of the present invention also provide targets for diagnosing active protein activity, disease, or predisposition to disease, in a patient having a variant peptide, particularly activities and conditions that are known for other members of the family of proteins to which the present one belongs. Thus, the peptide can be isolated from a biological sample and assayed for the presence of a genetic mutation that results in aberrant peptide. This includes amino acid substitution, deletion, insertion, rearrangement, (as the result of aberrant splicing events), and inappropriate post-translational modification. Analytic methods include altered electrophoretic mobility, altered tryptic peptide digest, altered CCAT activity in cell-based or cell-free assay, alteration in substrate or antibody-binding pattern, altered isoelectric point, direct amino acid sequencing, and any other of the known assay techniques useful for detecting mutations in a protein. Such an assay can be provided in a single detection format or a multi-detection format such as an antibody chip array.

In vitro techniques for detection of peptide include enzyme linked immunosorbent assays (ELISAs), Western blots, immunoprecipitations and immunofluorescence using a detection reagent, such as an antibody or protein binding agent. Alternatively, the peptide can be detected in vivo in a subject by introducing into the subject a labeled anti-peptide antibody or other types of detection agent. For example, the antibody can be labeled with a radioactive marker whose presence and location in a subject can be detected by standard imaging techniques. Particularly useful are methods that detect the allelic variant of a peptide expressed in a subject and methods which detect fragments of a peptide in a sample.

The peptides are also useful in pharmacogenomic analysis. Pharmacogenomics deal with clinically significant hereditary variations in the response to drugs due to altered drug disposition and abnormal action in affected persons. See, e.g., Eichelbaum, M. (Clin. Exp. Pharmacol. Physiol. 23(10-11): 983-985 (1996)), and Linder, M. W. (Clin. Chem. 43(2):254-266 (1997)). The clinical outcomes of these variations result in severe toxicity of therapeutic drugs in certain individuals or therapeutic failure of drugs in certain individuals as a result of individual variation in metabolism. Thus, the genotype of the individual can determine the way a therapeutic compound acts on the body or the way the body metabolizes the compound. Further, the activity of drug metabolizing enzymes affects both the intensity and duration of drug action. Thus, the pharmacogenomics of the individual permit the selection of effective compounds and effective dosages of such compounds for prophylactic or therapeutic treatment based on the individual's genotype. The discovery of genetic polymorphisms in some drug metabolizing enzymes has explained why some patients do not obtain the expected drug effects, show an exaggerated drug effect, or experience serious toxicity from standard drug dosages. Polymorphisms can be expressed in the phenotype of the extensive metabolizer and the phenotype of the poor metabolizer. Accordingly, genetic polymorphism may lead to allelic protein variants of the CCAT protein in which one or more of the CCAT functions in one population are different from those in another population. The peptides thus allow a target to ascertain a genetic predisposition that can affect treatment modality. Thus, in a ligand-based treatment, polymorphism may give rise to amino terminal extracellular domains and/or other substrate-binding regions that are more or less active in substrate binding, and CCAT activation. Accordingly, substrate dosage would necessarily be modified to maximize the therapeutic effect within a given population containing a polymorphism. As an alternative to genotyping, specific polymorphic peptides could be identified.

The peptides are also useful for treating a disorder characterized by an absence of, inappropriate, or unwanted expression of the protein. Experimental data as provided in Table 1 indicates expression in human colon tumor tissues. Accordingly, methods for treatment include the use of the CCAT protein or fragments.

Antibodies

The present invention provides antibodies specifically bind to CCAT proteins or fragments thereof, peptides, or antigenic portion thereof.

The invention also provides antibodies that selectively bind to one of the peptides of the present invention, a protein comprising such a peptide, as well as variants and fragments thereof as describe above.

The antibody of present invention selectively binds a target CCAT when it binds the target domain and does not significantly bind to unrelated proteins. An antibody is still considered to selectively bind a peptide even if it also binds to other proteins that are not substantially homologous with the target peptide so long as such proteins share homology with a fragment or domain of the peptide target of the antibody. In this case, it would be understood that antibody binding to the peptide is still selective despite some degree of cross-reactivity.

The term "antibody" is used in the broadest sense, and specifically covers monoclonal antibodies (including full length monoclonal antibodies), polyclonal antibodies, multi-specific antibodies (e.g., bispecific antibodies), humanized antibody and antibody fragments (e.g., Fab, F(ab').sub.2 and Fv) so long as they exhibit the desired biological activity. Antibodies (Abs) and immunoglobulins (Igs) are glycoproteins having the same structural characteristics. While antibodies exhibit binding specificity to a specific antigen, immunoglobulins include both antibodies and other antibody-like molecules that lack antigen specificity.

As used herein, antibodies are usually heterotetrameric glycoproteins of about 150,000 daltons, composed of two identical light (L) chains and two identical heavy (H) chains. Each light chain is linked to a heavy chain by one covalent disulfide bond, while the number of disulfide linkages varies between the heavy chains of different immunoglobulin isotypes. Each heavy and light chain also has regularly spaced intrachain disulfide bridges. Each heavy chain has at one end a variable domain (VH) followed by a number of constant domains. Each light chain has a variable domain at one end (VL) and a constant domain at its other end. The constant domain of the light chain is aligned with the first constant domain of the heavy chain, and the light chain variable domain is aligned with the variable domain of the heavy chain. Particular amino acid residues are believed to form an interface between the light and heavy chain variable domains. Chothia et al., J. Mol. Biol. 186, 651-63 (1985); Novotny and Haber, Proc. Natl. Acad. Sci. USA 82 4592-4596 (1985).

An "isolated" antibody is one which has been identified and separated and/or recovered from a component of the environment in which is produced. Contaminant components of its production environment are materials that would interfere with diagnostic or therapeutic uses for the antibody, and may include enzymes, hormones, and other proteinaceous or nonproteinaceous solutes. In preferred embodiments, the antibody will be purified as measurable by at least three different methods: 1) to greater than 95% by weight of antibody as determined by the Lowry method, and most preferably more than 99% by weight; 2) to a degree sufficient to obtain at least 15 residues of N-terminal or internal amino acid sequence by use of a spinning cup sequenator; or 3) to homogeneity by SDS-PAGE under reducing or non-reducing conditions using Coomasie blue or, preferably, silver stain. Isolated antibody includes the antibody in situ within recombinant cells since at least one component of the antibody's natural environment will not be present. Ordinarily, however, isolated antibody will be prepared by at least one purification step.

An "antigenic region" or "antigenic determinant" or an "epitope" includes any protein determinant capable of specific binding to an antibody. This is the site on an antigen to which each distinct antibody molecule binds. Epitopic determinants usually consist of active surface groupings of molecules such as amino acids or sugar side chains and usually have specific three-dimensional structural characteristics, as well as charge characteristics.

"Antibody specificity," is an antibody, which has a stronger binding affinity for an antigen from a first subject species than it has for a homologue of that antigen from a second subject species. Normally, the antibody "bind specifically" to a human antigen (i.e., has a binding affinity (Kd) value of no more than about $1 \times 10^{-7}$ M, preferably no more than about $1 \times 10^{-8}$ M and most preferably no more than about $1 \times 10^{-9}$ M) but has a binding affinity for a homologue of the antigen from a second subject species which is at least about 50 fold, or at least about 500 fold, or at least about 1000 fold, weaker than its binding affinity for the human antigen. The antibody can be of any of the various types of antibodies as defined above, but preferably is a humanized or human antibody (Queen et al., U.S. Pat. Nos. 5,530,101, 5,585,089; 5,693,762; and 6,180,370).

The present invention provides an "antibody variant," which refers to an amino acid sequence variant of an antibody wherein one or more of the amino acid residues have been modified. Such variant necessarily have less than 100% sequence identity or similarity with the amino acid sequence having at least 75% amino acid sequence identity or similarity with the amino acid sequence of either the heavy or light chain variable domain of the antibody, more preferably at least 80%, more preferably at least 85%, more preferably at least 90%, and most preferably at least 95%. Since the method of the invention applies equally to both polypeptides, antibodies and fragments thereof, these terms are sometimes employed interchangeably.

The term "variable" in the context of variable domain of antibodies refers to the fact that certain portions of the variable domains differ extensively in sequence among antibodies and are used in the binding and specificity of each particular antibody for its particular antigen. However, the variability is not evenly distributed through the variable domains of antibodies. It is concentrated in three segments called complementarity determining regions (CDRs) also known as hypervariable regions both in the light chain and the heavy chain variable domains. There are at least two techniques for determining CDRs: (1) an approach based on cross-species sequence variability (i.e., Kabat et al., Sequences of Proteins of Immunological Interest (National Institute of Health, Bethesda, Md. 1987); and (2) an approach based on crystallographic studies of antigen-antibody complexes (Chothia, C. et al. (1989), Nature 342: 877). The more highly conserved portions of variable domains are called the framework (FR). The variable domains of native heavy and light chains each comprise four FR regions, largely adopting a β-Sheet configuration, connected by three CDRs, which form loops connecting, and in some cases forming part of, the β-sheet structure. The CDRs in each chain are held together in close proximity by the FR regions and, with the CDRs from the other chain, contribute to the formation of the antigen-binding site of antibodies (see Kabat et al.) The constant domains are not involved directly in binding an antibody to an antigen, but exhibit various effector functions, such as participation of the antibody in antibody-dependent cellular toxicity.

The term "antibody fragment" refers to a portion of a full-length antibody, generally the antigen binding or variable region. Examples of antibody fragments include Fab, Fab', F(ab')$_2$ and Fv fragments. Papain digestion of antibodies produces two identical antigen binding fragments, called the Fab fragment, each with a single antigen binding site, and a residual "Fc" fragment, so-called for its ability to crystallize readily. Pepsin treatment yields an F(ab')$_2$ fragment that has two antigen binding fragments which are capable of crosslinking antigen, and a residual other fragment (which is termed pFc'). Additional fragments can include diabodies, linear antibodies, single-chain antibody molecules, and multispecific antibodies formed from antibody fragments. As used herein, "functional fragment" with respect to antibodies, refers to Fv, F(ab) and F(ab')$_2$ fragments.

An "Fv" fragment is the minimum antibody fragment that contains a complete antigen recognition and binding site. This region consists of a dimer of one heavy and one light chain variable domain in a tight, non-covalent association ($V_H$-$V_L$ dimer). It is in this configuration that the three CDRs of each variable domain interact to define an antigen-binding site on the surface of the $V_H$-$V_L$ dimer. Collectively, the six CDRs confer antigen-binding specificity to the antibody. However, even a single variable domain (or half of an Fv comprising only three CDRs specific for an antigen) has the ability to recognize and bind antigen, although at a lower affinity than the entire binding site.

The Fab fragment [also designated as F(ab)] also contains the constant domain of the light chain and the first constant domain (CH1) of the heavy chain. Fab' fragments differ from Fab fragments by the addition of a few residues at the carboxyl terminus of the heavy chain CH1 domain including one or more cysteines from the antibody hinge region. Fab'-SH is the designation herein for Fab' in which the cysteine residue (s) of the constant domains have a free thiol group. F(ab') fragments are produced by cleavage of the disulfide bond at the hinge cysteines of the F(ab')$_2$ pepsin digestion product. Additional chemical couplings of antibody fragments are known to those of ordinary skill in the art.

The present invention further provides monoclonal antibodies, polyclonal antibodies as well as humanized antibody. In general, to generate antibodies, an isolated peptide is used as an immunogen and is administered to a mammalian organism, such as a rat, rabbit or mouse. The full-length protein, an antigenic peptide fragment or a fusion protein of the CCAT protein can be used. Particularly important fragments are those covering functional domains. Many methods are known for generating and/or identifying antibodies to a given target peptide. Several such methods are described by Harlow, Antibodies, Cold Spring Harbor Press, (1989).

The term "monoclonal antibody" as used herein refers to an antibody obtained from a population of substantially homogeneous antibodies, i.e., the individual antibodies comprising the population are identical except for possible naturally occurring mutations that may be present in minor amounts. Monoclonal antibodies are highly specific, being directed against a single antigenic site. Furthermore, in contrast to conventional (polyclonal) antibody preparations which typically include different antibodies directed against different determinants (epitopes), each monoclonal antibody is directed against a single determinant on the antigen. In additional to their specificity, the monoclonal antibodies are advantageous in that they are synthesized by the hybridoma culture, uncontaminated by other immunoglobulins. The modifier "monoclonal" antibody indicates the character of the antibody as being obtained from a substantially homogeneous population of antibodies, and is not to be construed as requiring production of the antibody by any particular method. For example, the monoclonal antibodies to be used in accordance with the present invention may be made by the hybridoma method first described by Kohler and Milstein, Nature 256, 495 (1975), or may be made by recombinant methods, e.g., as described in U.S. Pat. No. 4,816,567. The monoclonal antibodies for use with the present invention may also be isolated from phage antibody libraries using the techniques described in Clackson et al. Nature 352: 624-628 (1991), as well as in Marks et al., J. Mol. Biol. 222: 581-597 (1991). For detailed procedures for making a monoclonal antibody, see the Example below.

"Humanized" forms of non-human (e.g. murine or rabbit) antibodies are chimeric immunoglobulins, immunoglobulin chains or fragments thereof (such as Fv, Fab, Fab', F(ab').sub.2 or other antigen-binding subsequences of antibodies) which contain minimal sequence derived from non-human immunoglobulin. For the most part, humanized antibodies are human immunoglobulins (recipient antibody) in which residues from a complementary determining region (CDR) of the recipient are replaced by residues from a CDR of a non-human species (donor antibody) such as mouse, rat or rabbit having the desired specificity, affinity and capacity. In some instances, Fv framework residues of the human immunoglobulin are replaced by corresponding non-human residues. Furthermore, humanized antibody may comprise residues, which are found neither in the recipient antibody nor in the imported CDR or framework sequences. These modifications are made to further refine and optimize antibody performance. In general, the humanized antibody will comprise substantially all of at least one, and typically two, variable domains, in which all or substantially all of the CDR regions correspond to those of a non-human immunoglobulin and all or substantially all of the FR regions are those of a human immunoglobulin consensus sequence. The humanized antibody optimally also will comprise at least a portion of an immunoglobulin constant region (Fc), typically that of a human immunoglobulin. For further details, see: Jones et al., Nature 321, 522-525 (1986); Reichmann et al., Nature 332, 323-327 (1988) and Presta, Curr. Op. Struct. Biol. 2, 593-596 (1992).

Polyclonal antibodies may be prepared by any known method or modifications of these methods including obtaining antibodies from patients. For example, a complex of an immunogen such as CCAT protein, peptides or fragments thereof and a carrier protein is prepared and an animal is immunized by the complex according to the same manner as that described with respect to the above monoclonal antibody preparation and the description in the Example. A serum or plasma containing the antibody against the protein is recovered from the immunized animal and the antibody is separated and purified. The gamma globulin fraction or the IgG antibodies can be obtained, for example, by use of saturated ammonium sulfate or DEAE Sephadex, or other techniques known to those skilled in the art.

The antibody titer in the antiserum can be measured according to the same manner as that described above with respect to the supernatant of the hybridoma culture. Separation and purification of the antibody can be carried out according to the same separation and purification method of antibody as that described with respect to the above monoclonal antibody and in the Example.

The protein used here in as the immunogen is not limited to any particular type of immunogen. In one aspect, antibodies are preferably prepared from regions or discrete fragments of the CCAT proteins. Antibodies can be prepared from any region of the peptide as described herein. In particular, they are selected from a group consisting of SEQ ID NOS: 1332-1501 and fragments of SEQ ID NOS: 1-683. An antigenic fragment will typically comprise at least 8 contiguous amino acid residues. The antigenic peptide can comprise, however, at least 10, 12, 14, 16 or more amino acid residues. Such fragments can be selected on a physical property, such as fragments correspond to regions that are located on the surface of the protein, e.g., hydrophilic regions or can be selected based on sequence uniqueness.

Antibodies may also be produced by inducing production in the lymphocyte population or by screening antibody libraries or panels of highly specific binding reagents as disclosed in Orlandi et al. (1989; Proc Natl Acad Sci 86:3833-3837) or Winter et al. (1991; Nature 349:293-299). A protein may be used in screening assays of phagemid or B-lymphocyte immunoglobulin libraries to identify antibodies having a desired specificity. Numerous protocols for competitive binding or immunoassays using either polyclonal or monoclonal antibodies with established specificities are well known in the art. Smith G. P., 1991, Curr. Opin. Biotechnol. 2: 668-673.

The antibodies of the present invention can also be generated using various phage display methods known in the art. In phage display methods, functional antibody domains are displayed on the surface of phage particles which carry the polynucleotide sequences encoding them. In a particular, such phage can be utilized to display antigen-binding domains expressed from a repertoire or combinatorial antibody library (e.g., human or murine). Phage expressing an antigen binding domain that binds the antigen of interest can be selected or identified with antigen, e.g., using labeled antigen or antigen bound or captured to a solid surface or bead. Phage used in these methods are typically filamentous phage including fd and M13 binding domains expressed from phage with Fab, Fv or disulfide stabilized Fv antibody domains recombinantly fused to either the phage gene III or gene VIII protein. Examples of phage display methods that can be used to make the antibodies of the present invention include those disclosed in Brinkman et al., J. Immunol. Methods 182:41-50 (1995); Ames et al., J. Immunol. Methods 184:177-186 (1995); Kettleborough et al., Eur. J. Immunol. 24:952-958 (1994); Persic et al., Gene 187 9-18 (1997); Burton et al., Advances in Immunology 57:191-280 (1994); PCT application No. PCT/GB91/01134; PCT publications WO 90/02809; WO 91/10737; WO 92/01047; WO 92/18619; WO 93/11236; WO 95/15982; WO 95/20401; and U.S. Pat. Nos. 5,698,426; 5,223,409; 5,403,484; 5,580,717; 5,427,908; 5,750,753; 5,821,047; 5,571,698; 5,427,908; 5,516,637; 5,780,225; 5,658,727; 5,733,743 and 5,969,108; each of which is incorporated herein by reference in its entirety.

Antibody can be also made recombinantly. When using recombinant techniques, the antibody variant can be produced intracellularly, in the periplasmic space, or directly secreted into the medium. If the antibody variant is produced intracellularly, as a first step, the particulate debris, either host cells or lysed fragments, is removed, for example, by centrifugation or ultrafiltration. Carter et al., Bio/Technology 10: 163-167 (1992) describe a procedure for isolating antibodies which are secreted to the periplasmic space of E. coli. Briefly, cell paste is thawed in the presence of sodium acetate (pH 3.5), EDTA, and phenylmethylsulfonylfluoride (PMSF) over about 30 minutes. Cell debris can be removed by centrifugation. Where the antibody variant is secreted into the medium, supernatants from such expression systems are generally first concentrated using a commercially available protein concentration filter, for example, an Amicon or Millipore Pellicon ultrafiltration unit. A protease inhibitor such as PMSF may be included in any of the foregoing steps to inhibit proteolysis and antibiotics may be included to prevent the growth of adventitious contaminants.

The antibodies or antigen binding fragments may also be produced by genetic engineering. The technology for expression of both heavy and light cain genes in E. coli is the subject the following PCT patent applications; publication number WO 901443, WO901443, and WO 9014424 and in Huse et al., 1989 Science 246:1275-1281. The general recombinant methods are well known in the art.

The antibody composition prepared from the cells can be purified using, for example, hydroxylapatite chromatography, gel elecrophoresis, dialysis, and affinity chromatography, with affinity chromatography being the preferred purification technique. The suitability of protein A as an affinity ligand depends on the species and isotype of any immunoglobulin Fc domain that is present in the antibody. Protein A can be used to purify antibodies that are based on human .delta.1, .delta.2 or .delta.4 heavy chains (Lindmark et al., J. Immunol. Meth. 62: 1-13 (1983)). Protein G is recommended for all mouse isotypes and for human .delta.3 (Guss et al., EMBO J. 5: 1567-1575 (1986)). The matrix to which the affinity ligand is attached is most often agarose, but other matrices are available. Mechanically stable matrices such as controlled pore glass or poly(styrenedivinyl)benzene allow for faster flow rates and shorter processing times than can be achieved with agarose. Where the antibody comprises a CH3 domain, the Bakerbond ABX™ resin (J.T. Baker, Phillipsburg, N.J.) is useful for purification. Other techniques for protein purification such as fractionation on an ion-exchange column, ethanol precipitation, Reverse Phase HPLC, chromatography on silica, chromatography on heparin SEPHAROSE™ chromatography on an anion or cation exchange resin (such as a polyaspartic acid column), chromatofocusing, SDS-PAGE, and ammonium sulfate precipitation are also available depending on the antibody to be recovered.

Following any preliminary purification step(s), the mixture comprising the antibody of interest and contaminants may be subjected to low pH hydrophobic interaction chromatography using an elution buffer at a pH between about 2.5-4.5, preferably performed at low salt concentrations (e.g., from about 0-0.25M salt).

Antibody Uses

The antibodies can be used to isolate one of the proteins of the present invention by standard techniques, such as affinity chromatography or immunoprecipitation. The antibodies can facilitate the purification of the natural protein from cells and recombinantly produced protein expressed in host cells. In addition, such antibodies are useful to detect the presence of one of the proteins of the present invention in cells or tissues to determine the pattern of expression of the protein among various tissues in an organism and over the course of normal development. Experimental data as provided in Table 1 indicate that the CCAT of the present invention are overexpressed in colon tumor tissue. Further, such antibodies can be used to detect protein in situ, in vitro, or in a cell lysate or supernatant in order to evaluate the abundance and pattern of expression. Also, such antibodies can be used to assess abnormal tissue distribution or abnormal expression during development or progression of a biological condition. Antibody detection of circulating fragments of the full length protein can be used to identify turnover.

Further, the antibodies can be used to assess expression in disease states such as in active stages of the disease or in an individual with a predisposition toward disease related to the protein's function. When a disorder is caused by an inappropriate tissue distribution, developmental expression, level of expression of the protein, or expressed/processed form, the antibody can be prepared against the normal protein. Experimental data as provided in Table 1 indicates expression in human colon tumor tissues. If a disorder is characterized by a specific mutation in the protein, antibodies specific for this mutant protein can be used to assay for the presence of the specific mutant protein.

The antibodies can also be used to assess normal and aberrant subcellular localization of cells in the various tissues in an organism. Experimental data as provided in Table 1 indicates expression in human colon tumor tissues. The diagnostic uses can be applied, not only in genetic testing, but also in monitoring a treatment modality. Accordingly, where treatment is ultimately aimed at correcting expression level or the presence of aberrant sequence and aberrant tissue distribution or developmental expression, antibodies directed against the protein or relevant fragments can be used to monitor therapeutic efficacy. More detection and diagnostic methods are described in detail below.

Additionally, antibodies are useful in pharmacogenomic analysis. Thus, antibodies prepared against polymorphic proteins can be used to identify individuals that require modified treatment modalities. The antibodies are also useful as diagnostic tools as an immunological marker for aberrant protein analyzed by electrophoretic mobility, isoelectric point, tryptic peptide digest, and other physical assays known to those in the art.

The antibodies are also useful for tissue typing. Experimental data as provided in Table 1 indicates expression in human colon tumor tissues. Thus, where a specific protein has been correlated with expression in a specific tissue, antibodies that are specific for this protein can be used to identify a tissue type.

The antibodies are also useful for inhibiting protein function, for example, blocking the binding of the CCAT peptide to a binding partner such as a substrate or another antibody binding to CCATs. These uses can also be applied in a therapeutic context in which treatment involves inhibiting the protein's function. An antibody can be used, for example, to block binding, thus modulating (agonizing or antagonizing) the peptides activity. Antibodies can be prepared against specific fragments containing sites required for function or against intact protein that is associated with a cell or cell membrane. More therapeutics methods are described in detail below.

The invention also encompasses kits for using antibodies to detect the presence of a protein in a biological sample. The kit can comprise antibodies such as a labeled or labelable antibody and a compound or agent for detecting protein in a biological sample; means for determining the amount of protein in the sample; means for comparing the amount of protein in the sample with a standard; and instructions for use. Such a kit can be supplied to detect a single protein or epitope or can be configured to detect one of a multitude of epitopes, such as in an antibody detection array. Arrays are described in detail below for nucleic acid arrays and similar methods have been developed for antibody arrays.

Nucleic Acid Molecules

The present invention further provides isolated nucleic acid molecules that encode a CCAT peptide or protein of the present invention. Such nucleic acid molecules will consist of, consist essentially of, or comprise a nucleotide sequence that encodes one of the CCAT peptides of the present invention, an allelic variant thereof, or an ortholog or paralog thereof. The nucleic acid molecules and the fragments thereof of the present invention pertains, however, are not to be construed as encompassing fragments that may be disclosed publicly prior to the present invention.

As used herein, an "isolated" nucleic acid molecule is one that is separated from other nucleic acid present in the natural source of the nucleic acid. Preferably, an "isolated" nucleic acid is free of sequences which naturally flank the nucleic acid (i.e., sequences located at the 5' and 3' ends of the nucleic acid) in the genomic DNA of the organism from which the nucleic acid is derived. However, there can be some flanking nucleotide sequences, for example up to about 5 KB, 4 KB, 3 KB, 2 KB, or 1 KB or less, particularly contiguous peptide encoding sequences and peptide encoding sequences within the same gene but separated by introns in the genomic sequence. The important point is that the nucleic acid is isolated from remote and unimportant flanking sequences such that it can be subjected to the specific manipulations described herein such as recombinant expression, preparation of probes and primers, and other uses specific to the nucleic acid sequences.

Moreover, an "isolated" nucleic acid molecule, such as a transcript/cDNA molecule, can be substantially free of other cellular material, or culture medium when produced by recombinant techniques, or chemical precursors or other chemicals when chemically synthesized. However, the nucleic acid molecule can be fused to other coding or regulatory sequences and still be considered isolated.

For example, recombinant DNA molecules contained in a vector are considered isolated. Further examples of isolated DNA molecules include recombinant DNA molecules maintained in heterologous host cells or purified (partially or substantially) DNA molecules in solution. Isolated RNA molecules include in vivo or in vitro RNA transcripts of the isolated DNA molecules of the present invention. Isolated nucleic acid molecules according to the present invention further include such molecules produced synthetically.

The present invention further provides nucleic acid molecules that comprise the nucleotide sequences shown in Table 1, (SEQ ID NOS: 684-1331), or any nucleic acid molecule that encodes a protein provided in Table 1, (SEQ ID NOS:

1-683). A nucleic acid molecule comprises a nucleotide sequence when the nucleotide sequence is at least part of the final nucleotide sequence of the nucleic acid molecule. In such a fashion, the nucleic acid molecule can be only the nucleotide sequence or have additional nucleic acid residues, such as nucleic acid residues that are naturally associated with it or heterologous nucleotide sequences. Such a nucleic acid molecule can have a few additional nucleotides or can comprise several hundred or more additional nucleotides. A brief description of how various types of these nucleic acid molecules can be readily made/isolated is provided below.

In Table 1, human transcript sequences are provided. As discussed below, some of the non-coding regions, particularly gene regulatory elements such as promoters, are useful for a variety of purposes, e.g. control of heterologous gene expression, target for identifying gene activity modulating compounds, and are particularly claimed as fragments of the genomic sequence provided herein.

The isolated nucleic acid molecules can encode the mature protein plus additional amino or carboxyl-terminal amino acids, or amino acids interior to the mature peptide (when the mature form has more than one peptide chain, for instance). Such sequences may play a role in processing of a protein from precursor to a mature form, facilitate protein trafficking, prolong or shorten protein half-life or facilitate manipulation of a protein for assay or production, among other things. As generally is the case in situ, the additional amino acids may be processed away from the mature protein by cellular enzymes.

As mentioned above, the isolated nucleic acid molecules include, but are not limited to, the sequence encoding the CCAT peptide alone, the sequence encoding the mature peptide and additional coding sequences, such as a leader or secretory sequence (e.g., a pre-pro or pro-protein sequence), the sequence encoding the mature peptide, with or without the additional coding sequences, plus additional non-coding sequences, for example introns and non-coding 5' and 3' sequences such as transcribed but non-translated sequences that play a role in transcription, mRNA processing (including splicing and polyadenylation signals), ribosome binding and stability of mRNA. In addition, the nucleic acid molecule may be fused to a marker sequence encoding, for example, a peptide that facilitates purification.

Isolated nucleic acid molecules can be in the form of RNA, such as mRNA, or in the form DNA, including cDNA and genomic DNA obtained by cloning or produced by chemical synthetic techniques or by a combination thereof. The nucleic acid, especially DNA, can be double-stranded or single-stranded. Single-stranded nucleic acid can be the coding strand (sense strand) or the non-coding strand (anti-sense strand).

The invention further provides nucleic acid molecules that encode fragments of the peptides of the present invention as well as nucleic acid molecules that encode obvious variants of the CCAT proteins of the present invention that are described above. Such nucleic acid molecules may be naturally occurring, such as allelic variants (same locus), paralogs (different locus), and orthologs (different organism), or may be constructed by recombinant DNA methods or by chemical synthesis. Such non-naturally occurring variants may be made by mutagenesis techniques, including those applied to nucleic acid molecules, cells, or organisms. Accordingly, as discussed above, the variants can contain nucleotide substitutions, deletions, inversions and insertions. Variation can occur in either or both the coding and non-coding regions. The variations can produce both conservative and non-conservative amino acid substitutions.

The present invention further provides non-coding fragments of the nucleic acid molecules provided in Table 1. Preferred non-coding fragments include, but are not limited to, promoter sequences, enhancer sequences, gene modulating sequences and gene termination sequences. Such fragments are useful in controlling heterologous gene expression and in developing screens to identify gene-modulating agents. A promoter can readily be identified as being 5' to the ATG start site in the genomic sequence.

A fragment comprises a contiguous nucleotide sequence greater than 12 or more nucleotides. Further, a fragment could at least 30, 40, 50, 100, 250 or 500 nucleotides in length. The length of the fragment will be based on its intended use. For example, the fragment can encode epitope bearing regions of the peptide, or can be useful as DNA probes and primers. Such fragments can be isolated using the known nucleotide sequence to synthesize an oligonucleotide probe. A labeled probe can then be used to screen a cDNA library, genomic DNA library, or mRNA to isolate nucleic acid corresponding to the coding region. Further, primers can be used in PCR reactions to clone specific regions of the gene.

A probe/primer typically comprises substantially a purified oligonucleotide or oligonucleotide pair. The oligonucleotide typically comprises a region of nucleotide sequence that hybridizes under stringent conditions to at least about 12, 20, 25, 40, 50 or more consecutive nucleotides.

Orthologs, homologs, and allelic variants can be identified using methods well known in the art. As described in the Peptide Section, these variants comprise a nucleotide sequence encoding a peptide that is typically 60-70%, 70-80%, 80-90%, and more typically at least about 90-95% or more homologous to a nucleotide sequence shown in the Table 1 or a fragment of this sequence. Such nucleic acid molecules can readily be identified as being able to hybridize under moderate to stringent conditions, to a nucleotide sequence shown in Table 1 or a fragment of the sequence. Allelic variants can readily be determined by genetic locus of the encoding gene.

As used herein, the term "hybridizes under stringent conditions" is intended to describe conditions for hybridization and washing under which nucleotide sequences encoding a peptide at least 60-70% homologous to each other typically remain hybridized to each other. The conditions can be such that sequences at least about 60%, at least about 70%, or at least about 80% or more homologous to each other typically remain hybridized to each other. Such stringent conditions are known to those skilled in the art and can be found in Current Protocols in Molecular Biology, John Wiley & Sons, N.Y. (1989), 6.3.1-6.3.6. One example of stringent hybridization conditions is hybridization in 6× sodium chloride/sodium citrate (SSC) at about 45C, followed by one or more washes in 0.2×SSC, 0.1% SDS at 50-65C. Examples of moderate to low stringency hybridization conditions are well known in the art.

Nucleic Acid Molecule Uses

The nucleic acid molecules of the present invention are useful for probes, primers, chemical intermediates, and in biological assays. The nucleic acid molecules are useful as a hybridization probe for messenger RNA, transcript/cDNA and genomic DNA to isolate full-length cDNA and genomic clones encoding a peptide described in Table 1 and to isolate cDNA and genomic clones that correspond to variants (alleles, orthologs, etc.) producing the same or related peptides shown in Table 1.

The probe can correspond to any sequence along the entire length of a nucleic acid molecule provided in Table 1. Accordingly, it could be derived from 5' noncoding regions, the coding region, and 3' noncoding regions. However, as discussed, fragments are not to be construed as encompassing fragments disclosed prior to the present invention.

The nucleic acid molecules are also useful as primers for PCR to amplify any given region of a nucleic acid molecule and are useful to synthesize antisense molecules of desired length and sequence.

The nucleic acid molecules are also useful for constructing recombinant vectors. Such vectors include expression vectors that express a portion of, or all of, the peptide sequences. Vectors also include insertion vectors, used to integrate into another nucleic acid molecule sequence, such as into the cellular genome, to alter in situ expression of a gene and/or gene product. For example, an endogenous coding sequence can be replaced via homologous recombination with all or part of the coding region containing one or more specifically introduced mutations.

The nucleic acid molecules are also useful for expressing antigenic portions of the proteins.

The nucleic acid molecules are also useful as probes for determining the chromosomal positions of the nucleic acid molecules by means of in situ hybridization methods.

The nucleic acid molecules are also useful in making vectors containing the gene regulatory regions of the nucleic acid molecules of the present invention.

The nucleic acid molecules are also useful for designing ribozymes corresponding to all, or a part, of the mRNA produced from the nucleic acid molecules described herein. The nucleic acid molecules are also useful for making vectors that express part, or all, of the peptides.

The nucleic acid molecules are also useful for constructing host cells expressing a part, or all, of the nucleic acid molecules and peptides.

The nucleic acid molecules are also useful for constructing transgenic animals expressing all, or a part, of the nucleic acid molecules and peptides.

The nucleic acid molecules are also useful as hybridization probes for determining the presence, level, form and distribution of nucleic acid expression. Experimental data as provided in Table 1 indicate that the CCAT of the present invention are overexpressed in colon tumor tissue. Accordingly, the probes can be used to detect the presence of, or to determine levels of, a specific nucleic acid molecule in cells, tissues, and in organisms. The nucleic acid whose level is determined can be DNA or RNA. Accordingly, probes corresponding to the peptides described herein can be used to assess expression and/or gene copy number in a given cell, tissue, or organism. These uses are relevant for diagnosis of disorders involving an increase or decrease in CCAT protein expression relative to normal results.

In vitro techniques for detection of mRNA include Northern hybridizations and in situ hybridizations. In vitro techniques for detecting DNA include Southern hybridizations and in situ hybridization.

Probes can be used as a part of a diagnostic test kit for identifying cells or tissues that express a CCAT protein, such as by measuring a level of a CCAT-encoding nucleic acid in a sample of cells from a subject e.g., mRNA or genomic DNA, or determining if a CCAT gene has been mutated. Experimental data as provided in Table 1 indicate that the CCAT of the present invention are overexpressed in colon tumor tissue. More detection and diagnosis methods are described in detail below.

Nucleic acid expression assays are useful for drug screening to identify compounds that modulate CCAT nucleic acid expression.

The invention thus provides a method for identifying a compound that can be used to treat a disorder associated with nucleic acid expression of the CCAT gene, particularly biological and pathological processes that are mediated by the CCAT in cells and tissues that express it. Experimental data as provided in Table 1 indicates expression in human colon tumor tissues. The method typically includes assaying the ability of the compound to modulate the expression of the CCAT nucleic acid and thus identifying a compound that can be used to treat a disorder characterized by undesired CCAT nucleic acid expression. The assays can be performed in cell-based and cell-free systems. Cell-based assays include cells naturally expressing the CCAT nucleic acid or recombinant cells genetically engineered to express specific nucleic acid sequences.

The assay for CCAT nucleic acid expression can involve direct assay of nucleic acid levels, such as mRNA levels, or on collateral compounds involved in the signal pathway. Further, the expression of genes that are up- or down-regulated in response to the CCAT protein signal pathway can also be assayed. In this embodiment the regulatory regions of these genes can be operably linked to a reporter gene such as luciferase.

Thus, modulators of CCAT gene expression can be identified in a method wherein a cell is contacted with a candidate compound or agent and the expression of mRNA determined. The level of expression of CCAT mRNA in the presence of the candidate compound or agent is compared to the level of expression of CCAT mRNA in the absence of the candidate compound or agent. The candidate compound can then be identified as a modulator of nucleic acid expression based on this comparison and be used, for example to treat a disorder characterized by aberrant nucleic acid expression. When expression of mRNA is statistically significantly greater in the presence of the candidate compound than in its absence, the candidate compound is identified as a stimulator of nucleic acid expression. When nucleic acid expression is statistically significantly less in the presence of the candidate compound than in its absence, the candidate compound is identified as an inhibitor of nucleic acid expression.

The invention further provides methods of treatment, with the nucleic acid as a target, using a compound or an agent identified through drug screening as a gene modulator to modulate CCAT nucleic acid expression in cells and tissues that express the CCAT. Experimental data as provided in Table 1 indicate that the CCAT of the present invention are overexpressed in colon tumor tissue. Modulation includes both up-regulation (i.e. activation or agonization) or down-regulation (suppression or antagonization) or nucleic acid expression.

Alternatively, a modulator for nucleic acid expression can be a small molecule or drug identified using the screening assays described herein as long as the drug or small molecule inhibits the CCAT nucleic acid expression in the cells and tissues that express the protein. Experimental data as provided in Table 1 indicates expression in human colon tumor tissues.

The nucleic acid molecules are also useful for monitoring the effectiveness of modulating compounds or agents on the expression or activity of the CCAT gene in clinical trials or in a treatment regimen. Thus, the gene expression pattern can serve as a barometer for the continuing effectiveness of treatment with the compound, particularly with compounds to which a patient can develop resistance. The gene expression pattern can also serve as a marker indicative of a physiological response of the affected cells to the compound. Accordingly, such monitoring would allow either increased administration of the compound or the administration of alternative compounds to which the patient has not become resistant. Similarly, if the level of nucleic acid expression falls below a desirable level, administration of the compound could be commensurately decreased.

The nucleic acid molecules are also useful in diagnostic assays for qualitative changes in CCAT nucleic acid expression, and particularly in qualitative changes that lead to pathology. The nucleic acid molecules can be used to detect mutations in CCAT genes and gene expression products such as mRNA. The nucleic acid molecules can be used as hybridization probes to detect naturally occurring genetic mutations in the CCAT gene and thereby to determine whether a subject with the mutation is at risk for a disorder caused by the mutation. Mutations include deletion, addition, or substitution of one or more nucleotides in the gene, chromosomal rearrangement, such as inversion or transposition, modification of genomic DNA, such as aberrant methylation patterns or changes in gene copy number, such as amplification. Detection of a mutated form of the CCAT gene associated with a dysfunction provides a diagnostic tool for an active disease or susceptibility to disease when the disease results from overexpression, underexpression, or altered expression of a CCAT protein.

Individuals carrying mutations in the CCAT gene can be detected at the nucleic acid level by a variety of techniques. Genomic DNA can be analyzed directly or can be amplified by using PCR prior to analysis. RNA or cDNA can be used in the same way. In some uses, detection of the mutation involves the use of a probe/primer in a polymerase chain reaction (PCR) (see, e.g. U.S. Pat. Nos. 4,683,195 and 4,683,202), such as anchor PCR or RACE PCR, or, alternatively, in a ligation chain reaction (LCR) (see, e.g., Landegran et al., Science 241:1077-1080 (1988); and Nakazawa et al., PNAS 91:360-364 (1994)), the latter of which can be particularly useful for detecting point mutations in the gene (see Abravaya et al., Nucleic Acids Res. 23:675-682 (1995)). This method can include the steps of collecting a sample of cells from a patient, isolating nucleic acid (e.g., genomic, mRNA or both) from the cells of the sample, contacting the nucleic acid sample with one or more primers which specifically hybridize to a gene under conditions such that hybridization and amplification of the gene (if present) occurs, and detecting the presence or absence of an amplification product, or detecting the size of the amplification product and comparing the length to a control sample. Deletions and insertions can be detected by a change in size of the amplified product compared to the normal genotype. Point mutations can be identified by hybridizing amplified DNA to normal RNA or antisense DNA sequences.

Alternatively, mutations in a CCAT gene can be directly identified, for example, by alterations in restriction enzyme digestion patterns determined by gel electrophoresis.

Further, sequence-specific ribozymes (U.S. Pat. No. 5,498,531) can be used to score for the presence of specific mutations by development or loss of a ribozyme cleavage site. Perfectly matched sequences can be distinguished from mismatched sequences by nuclease cleavage digestion assays or by differences in melting temperature.

Sequence changes at specific locations can also be assessed by nuclease protection assays such as RNase and S1 protection or the chemical cleavage method. Furthermore, sequence differences between a mutant CCAT gene and a wild-type gene can be determined by direct DNA sequencing. A variety of automated sequencing procedures can be utilized when performing the diagnostic assays (Naeve, C. W., (1995) Biotechniques 19:448), including sequencing by mass spectrometry (see, e.g., PCT International Publication No. WO 94/16101; Cohen et al., Adv. Chromatogr. 36:127-162 (1996); and Griffin et al., Appl. Biochem. Biotechnol. 38:147-159 (1993)).

Other methods for detecting mutations in the gene include methods in which protection from cleavage agents is used to detect mismatched bases in RNA/RNA or RNA/DNA duplexes (Myers et al., Science 230:1242 (1985)); Cotton et al., PNAS 85:4397 (1988); Saleeba et al., Meth. Enzymol. 217:286-295 (1992)), electrophoretic mobility of mutant and wild type nucleic acid is compared (Orita et al., PNAS 86:2766 (1989); Cotton et al., Mutat. Res. 285:125-144 (1993); and Hayashi et al., Genet. Anal. Tech. Appl. 9:73-79 (1992)), and movement of mutant or wild-type fragments in polyacrylamide gels containing a gradient of denaturant is assayed using denaturing gradient gel electrophoresis (Myers et al., Nature 313:495 (1985)). Examples of other techniques for detecting point mutations include selective oligonucleotide hybridization, selective amplification, and selective primer extension.

The nucleic acid molecules are also useful for testing an individual for a genotype that while not necessarily causing the disease, nevertheless affects the treatment modality. Thus, the nucleic acid molecules can be used to study the relationship between an individual's genotype and the individual's response to a compound used for treatment (pharmacogenomic relationship). Accordingly, the nucleic acid molecules described herein can be used to assess the mutation content of the CCAT gene in an individual in order to select an appropriate compound or dosage regimen for treatment.

Thus nucleic acid molecules displaying genetic variations that affect treatment provide a diagnostic target that can be used to tailor treatment in an individual. Accordingly, the production of recombinant cells and animals containing these polymorphisms allow effective clinical design of treatment compounds and dosage regimens.

The nucleic acid molecules are thus useful as antisense constructs to control CCAT gene expression in cells, tissues, and organisms. A DNA antisense nucleic acid molecule is designed to be complementary to a region of the gene involved in transcription, preventing transcription and hence production of CCAT protein. An antisense RNA or DNA nucleic acid molecule would hybridize to the mRNA and thus block translation of mRNA into CCAT protein.

The nucleic acid of the present invention may also be used to specifically suppress gene expression by methods such as RNA interference (RNAi), which may also include cosuppression and quelling. This and antisense RNA or DNA of gene suppression are well known in the art. A review of this technique is found in Science 288:1370-1372, 2000. RNAi also operates on a post-transcriptional level and is sequence specific, but suppresses gene expression far more efficiently than antisense RNA. RNAi fragments, particularly double-stranded (ds) RNAi, can be also used to generate loss-of-function phenotypes.

Alternatively, a class of antisense molecules can be used to inactivate mRNA in order to decrease expression of CCAT nucleic acid. Accordingly, these molecules can treat a disorder characterized by abnormal or undesired CCAT nucleic acid expression. This technique involves cleavage by means of ribozymes containing nucleotide sequences complementary to one or more regions in the mRNA that attenuate the ability of the mRNA to be translated. Possible regions include coding regions and particularly coding regions corresponding to the catalytic and other functional activities of the CCAT protein, such as substrate binding.

The nucleic acid molecules also provide vectors for gene therapy in patients containing cells that are aberrant in CCAT gene expression. Thus, recombinant cells, which include the patient's cells that have been engineered ex vivo and returned to the patient, are introduced into an individual where the cells produce the desired CCAT protein to treat the individual.

The invention also encompasses kits for detecting the presence of a CCAT nucleic acid in a biological sample. Experimental data as provided in Table 1 indicate that the CCAT of the present invention are overexpressed in colon tumor tissue. For example, the kit can comprise reagents such as a labeled or labelable nucleic acid or agent capable of detecting CCAT nucleic acid in a biological sample; means for determining the amount of CCAT nucleic acid in the sample; and means for comparing the amount of CCAT nucleic acid in the sample with a standard. The compound or agent can be packaged in a suitable container. The kit can further comprise instructions for using the kit to detect CCAT protein mRNA or DNA.

Vectors/Host Cells

The invention also provides vectors containing the nucleic acid molecules described herein. The term "vector" refers to a vehicle, preferably a nucleic acid molecule, which can transport the nucleic acid molecules. When the vector is a nucleic acid molecule, the nucleic acid molecules are covalently linked to the vector nucleic acid. With this aspect of the invention, the vector includes a plasmid, single or double stranded phage, a single or double stranded RNA or DNA viral vector, or artificial chromosome, such as a BAC, PAC, YAC, OR MAC.

A vector can be maintained in the host cell as an extrachromosomal element where it replicates and produces additional copies of the nucleic acid molecules. Alternatively, the vector may integrate into the host cell genome and produce additional copies of the nucleic acid molecules when the host cell replicates.

The invention provides vectors for the maintenance (cloning vectors) or vectors for expression (expression vectors) of the nucleic acid molecules. The vectors can function in prokaryotic or eukaryotic cells or in both (shuttle vectors).

Expression vectors contain cis-acting regulatory regions that are operably linked in the vector to the nucleic acid molecules such that transcription of the nucleic acid molecules is allowed in a host cell. The nucleic acid molecules can be introduced into the host cell with a separate nucleic acid molecule capable of affecting transcription. Thus, the second nucleic acid molecule may provide a trans-acting factor interacting with the cis-regulatory control region to allow transcription of the nucleic acid molecules from the vector. Alternatively, a trans-acting factor may be supplied by the host cell. Finally, a trans-acting factor can be produced from the vector itself. It is understood, however, that in some embodiments, transcription and/or translation of the nucleic acid molecules can occur in a cell-free system.

The regulatory sequences to which the nucleic acid molecules described herein can be operably linked include promoters for directing mRNA transcription. These include, but are not limited to, the left promoter from bacteriophage, the lac, TRP, and TAC promoters from *E. coli*, the early and late promoters from SV40, the CMV immediate early promoter, the adenovirus early and late promoters, and retrovirus long-terminal repeats.

In addition to control regions that promote transcription, expression vectors may also include regions that modulate transcription, such as repressor binding sites and enhancers. Examples include the SV40 enhancer, the cytomegalovirus immediate early enhancer, polyoma enhancer, adenovirus enhancers, and retrovirus LTR enhancers.

In addition to containing sites for transcription initiation and control, expression vectors can also contain sequences necessary for transcription termination and, in the transcribed region a ribosome binding site for translation. Other regulatory control elements for expression include initiation and termination codons as well as polyadenylation signals. The person of ordinary skill in the art would be aware of the numerous regulatory sequences that are useful in expression vectors. Such regulatory sequences are described, for example, in Sambrook et al., Molecular Cloning: A Laboratory Manual. 3rd. ed., Cold Spring Harbor Laboratory Press, Cold Spring Harbor, N.Y., (2001).

A variety of expression vectors can be used to express a nucleic acid molecule. Such vectors include chromosomal, episomal, and virus-derived vectors, for example vectors derived from bacterial plasmids, from bacteriophage, from yeast episomes, from yeast chromosomal elements, including yeast artificial chromosomes, from viruses such as baculoviruses, papovaviruses such as SV40, Vaccinia viruses, adenoviruses, poxviruses, pseudorabies viruses, and retroviruses. Vectors may also be derived from combinations of these sources such as those derived from plasmid and bacteriophage genetic elements, e.g. cosmids and phagemids. Appropriate cloning and expression vectors for prokaryotic and eukaryotic hosts are described in Sambrook et al., Molecular Cloning: A Laboratory Manual. 3rd. ed., Cold Spring Harbor Laboratory Press, Cold Spring Harbor, N.Y., (2001).

The regulatory sequence may provide constitutive expression in one or more host cells (i.e. tissue specific) or may provide for inducible expression in one or more cell types such as by temperature, nutrient additive, or exogenous factor such as a hormone or other ligand. A variety of vectors providing for constitutive and inducible expression in prokaryotic and eukaryotic hosts are well known to those of ordinary skill in the art.

The nucleic acid molecules can be inserted into the vector nucleic acid by well-known methodologies. Generally, the DNA sequence that will ultimately be expressed is joined to an expression vector by cleaving the DNA sequence and the expression vector with one or more restriction enzymes and then ligating the fragments together. Procedures for restriction enzyme digestion and ligation are well known to those of ordinary skill in the art.

The vector containing the appropriate nucleic acid molecule can be introduced into an appropriate host cell for propagation or expression using well-known techniques. Bacterial cells include, but are not limited to, *E. coli, Streptomyces*, and *Salmonella typhimurium*. Eukaryotic cells include, but are not limited to, yeast, insect cells such as *Drosophila*, animal cells such as COS and CHO cells, and plant cells.

As described herein, it may be desirable to express the peptide as a fusion protein. Accordingly, the invention provides fusion vectors that allow for the production of the peptides. Fusion vectors can increase the expression of a recombinant protein; increase the solubility of the recombinant protein, and aid in the purification of the protein by acting for example as a ligand for affinity purification. A proteolytic cleavage site may be introduced at the junction of the fusion moiety so that the desired peptide can ultimately be separated from the fusion moiety. Proteolytic enzymes include, but are not limited to, factor Xa, thrombin, and enteroenzyme. Typical fusion expression vectors include pGEX (Smith et al., Gene 67:31-40 (1988)), pMAL (New England Biolabs, Beverly, Mass.) and pRIT5 (Pharmacia, Piscataway, N.J.) which fuse glutathione S-transferase (GST), maltose E binding protein, or protein A, respectively, to the target recombinant protein. Examples of suitable inducible non-fusion *E. coli* expression vectors include pTrc (Amann et al., Gene 69:301-315 (1988)) and pET 11d (Studier et al., Gene Expression Technology: Methods in Enzymology 185:60-89 (1990)). Recombinant protein expression can be maximized in host bacteria by providing a genetic background wherein the host cell has an impaired capacity to proteolytically cleave the recombinant protein. (Gottesman, S., Gene Expression Technology: Methods in Enzymology 185, Academic Press, San Diego, Calif. (1990) 119-128). Alternatively, the sequence of the nucleic acid molecule of interest can be altered to provide preferential codon usage for a specific host cell, for example *E. coli*. (Wada et al., Nucleic Acids Res. 20:2111-2118 (1992)).

The nucleic acid molecules can also be expressed by expression vectors that are operative in yeast. Examples of vectors for expression in yeast e.g., *S. cerevisiae* include pYepSec1 (Baldari, et al., EMBO J. 6:229-234 (1987)), pMFa (Kurjan et al., Cell 30:933-943 (1982)), pJRY88 (Schultz et al., Gene 54:113-123 (1987)), and pYES2 (Invitrogen Corporation, San Diego, Calif.).

The nucleic acid molecules can also be expressed in insect cells using, for example, baculovirus expression vectors. Baculovirus vectors available for expression of proteins in cultured insect cells (e.g., Sf 9 cells) include the pAc series (Smith et al., Mol. Cell. Biol. 3:2156-2165 (1983)) and the pVL series (Lucklow et al., Virology 170:31-39 (1989)).

In certain embodiments of the invention, the nucleic acid molecules described herein are expressed in mammalian cells using mammalian expression vectors. Examples of mammalian expression vectors include pCDM8 (Seed, B. Nature 329:840 (1987)) and pMT2PC (Kaufman et al., EMBO J. 6:187-195 (1987)).

The expression vectors listed herein are provided by way of example only of the well-known vectors available to those of ordinary skill in the art that would be useful to express the nucleic acid molecules. The person of ordinary skill in the art would be aware of other vectors suitable for maintenance propagation or expression of the nucleic acid molecules described herein. These are found for example in Sambrook, J., Fritsh, E. F., and Maniatis, T. Molecular Cloning: A Laboratory Manual. 3rd, ed., Cold Spring Harbor Laboratory, Cold Spring Harbor Laboratory Press, Cold Spring Harbor, N.Y., 2001.

The invention also encompasses vectors in which the nucleic acid sequences described herein are cloned into the vector in reverse orientation, but operably linked to a regulatory sequence that permits transcription of antisense RNA. Thus, an antisense transcript can be produced to all, or to a portion, of the nucleic acid molecule sequences described herein, including both coding and non-coding regions. Expression of this antisense RNA is subject to each of the parameters described above in relation to expression of the sense RNA (regulatory sequences, constitutive or inducible expression, tissue-specific expression).

The invention also relates to recombinant host cells containing the vectors described herein. Host cells therefore include prokaryotic cells, lower eukaryotic cells such as yeast, other eukaryotic cells such as insect cells, and higher eukaryotic cells such as mammalian cells.

The recombinant host cells are prepared by introducing the vector constructs described herein into the cells by techniques readily available to the person of ordinary skill in the art. These include, but are not limited to, calcium phosphate transfection, DEAE-dextran-mediated transfection, cationic lipid-mediated transfection, electroporation, transduction, infection, lipofection, and other techniques such as those found in Sambrook, et al. (Molecular Cloning: A Laboratory Manual. 3rd, ed., Cold Spring Harbor Laboratory, Cold Spring Harbor Laboratory Press, Cold Spring Harbor, N.Y., 2001).

Host cells can contain more than one vector. Thus, different nucleotide sequences can be introduced on different vectors of the same cell. Similarly, the nucleic acid molecules can be introduced either alone or with other nucleic acid molecules that are not related to the nucleic acid molecules such as those providing trans-acting factors for expression vectors. When more than one vector is introduced into a cell, the vectors can be introduced independently, co-introduced or joined to the nucleic acid molecule vector.

In the case of bacteriophage and viral vectors, these can be introduced into cells as packaged or encapsulated virus by standard procedures for infection and transduction. Viral vectors can be replication-competent or replication-defective. In the case in which viral replication is defective, replication will occur in host cells providing functions that complement the defects.

Vectors generally include selectable markers that enable the selection of the subpopulation of cells that contain the recombinant vector constructs. The marker can be contained in the same vector that contains the nucleic acid molecules described herein or may be on a separate vector. Markers include tetracycline or ampicillin-resistance genes for prokaryotic host cells and dihydrofolate reductase or neomycin resistance for eukaryotic host cells. However, any marker that provides selection for a phenotypic trait will be effective.

While the mature proteins can be produced in bacteria, yeast, mammalian cells, and other cells under the control of the appropriate regulatory sequences, cell-free transcription and translation systems can also be used to produce these proteins using RNA derived from the DNA constructs described herein.

Where secretion of the peptide is desired, which may be difficult to achieve with multi-transmembrane domain containing proteins such as CCATs, appropriate secretion signals are incorporated into the vector. The signal sequence can be endogenous to the peptides or heterologous to these peptides.

Where the peptide is not secreted into the medium, which is typically the case with CCATs, the protein can be isolated from the host cell by standard disruption procedures, including freeze thaw, sonication, mechanical disruption, use of lysing agents and the like. The peptide can then be recovered and purified by well-known purification methods including ammonium sulfate precipitation, acid extraction, anion or cationic exchange chromatography, phosphocellulose chromatography, hydrophobic-interaction chromatography, affinity chromatography, hydroxylapatite chromatography, lectin chromatography, or high performance liquid chromatography.

It is also understood that depending upon the host cell in recombinant production of the peptides described herein, the peptides can have various glycosylation patterns, depending upon the cell, or maybe non-glycosylated as when produced in bacteria. In addition, the peptides may include an initial modified methionine in some cases as a result of a host-mediated process.

Uses of Vectors and Host Cells

The recombinant host cells expressing the peptides described herein have a variety of uses. First, the cells are useful for producing a CCAT protein or peptide that can be further purified to produce desired amounts of CCAT protein or fragments. Thus, host cells containing expression vectors are useful for peptide production.

Host cells are also useful for conducting cell-based assays involving the CCAT protein or CCAT protein fragments, such as those described above as well as other formats known in the art. Thus, a recombinant host cell expressing a native CCAT protein is useful for assaying compounds that stimulate or inhibit CCAT protein function.

Host cells are also useful for identifying CCAT protein mutants in which these functions are affected. If the mutants naturally occur and give rise to a pathology, host cells containing the mutations are useful to assay compounds that have a desired effect on the mutant CCAT protein (for example, stimulating or inhibiting function) which may not be indicated by their effect on the native CCAT protein.

Genetically engineered host cells can be further used to produce non-human transgenic animals. A transgenic animal is preferably a mammal, for example a rodent, such as a rat or mouse, in which one or more of the cells of the animal include a transgene. A transgene is exogenous DNA which is integrated into the genome of a cell from which a transgenic animal develops and which remains in the genome of the mature animal in one or more cell types or tissues of the transgenic animal. These animals are useful for studying the function of a CCAT protein and identifying and evaluating modulators of CCAT protein activity. Other examples of transgenic animals include non-human primates, sheep, dogs, cows, goats, chickens, and amphibians.

A transgenic animal can be produced by introducing nucleic acid into the male pronuclei of a fertilized oocyte, e.g., by microinjection, retroviral infection, and allowing the oocyte to develop in a pseudopregnant female foster animal. Any of the CCAT protein nucleotide sequences can be introduced as a transgene into the genome of a non-human animal, such as a mouse.

Any of the regulatory or other sequences useful in expression vectors can form part of the transgenic sequence. This includes intronic sequences and polyadenylation signals, if not already included. A tissue-specific regulatory sequence(s) can be operably linked to the transgene to direct expression of the CCAT protein to particular cells.

Methods for generating transgenic animals via embryo manipulation and microinjection, particularly animals such as mice, have become conventional in the art and are described, for example, in U.S. Pat. Nos. 4,736,866 and 4,870,009, both by Leder et al., U.S. Pat. No. 4,873,191 by Wagner et al. and in Hogan, B., Manipulating the Mouse Embryo, (Cold Spring Harbor Laboratory Press, Cold Spring Harbor, N.Y., 1986). Similar methods are used for production of other transgenic animals. A transgenic founder animal can be identified based upon the presence of the transgene in its genome and/or expression of transgenic mRNA in tissues or cells of the animals. A transgenic founder animal can then be used to breed additional animals carrying the transgene. Moreover, transgenic animals carrying a transgene can further be bred to other transgenic animals carrying other transgenes. A transgenic animal also includes animals in which the entire animal or tissues in the animal have been produced using the homologously recombinant host cells described herein.

In another embodiment, transgenic non-human animals can be produced which contain selected systems that allow for regulated expression of the transgene. One example of such a system is the cre/loxP recombinase system of bacteriophage P1. For a description of the cre/loxP recombinase system, see, e.g., Lakso et al. PNAS 89:6232-6236 (1992). Another example of a recombinase system is the FLP recombinase system of S. cerevisiae (O'Gorman et al. Science 251: 1351-1355 (1991). If a cre/loxP recombinase system is used to regulate expression of the transgene, animals containing transgenes encoding both the Cre recombinase and a selected protein is required. Such animals can be provided through the construction of "double" transgenic animals, e.g., by mating two transgenic animals, one containing a transgene encoding a selected protein and the other containing a transgene encoding a recombinase.

Clones of the non-human transgenic animals described herein can also be produced according to the methods described in Wilmut, I. et al. Nature 385:810-813 (1997) and PCT International Publication Nos. WO 97/07668 and WO 97/07669. In brief, a cell, e.g., a somatic cell, from the transgenic animal can be isolated and induced to exit the growth cycle and enter Go phase. The quiescent cell can then be fused, e.g., through the use of electrical pulses, to an enucleated oocyte from an animal of the same species from which the quiescent cell is isolated. The reconstructed oocyte is then cultured such that it develops to morula or blastocyst and then transferred to pseudopregnant female foster animal. The offspring born of this female foster animal will be a clone of the animal from which the cell, e.g., the somatic cell, is isolated.

Transgenic animals containing recombinant cells that express the peptides described herein are useful to conduct the assays described herein in an in vivo context. Accordingly, the various physiological factors that are present in vivo and that could effect substrate binding, CCAT protein activation, and signal transduction, may not be evident from in vitro cell-free or cell-based assays. Accordingly, it is useful to provide non-human transgenic animals to assay in vivo CCAT protein function, including substrate interaction, the effect of specific mutant CCAT proteins on CCAT protein function and substrate interaction, and the effect of chimeric CCAT proteins. It is also possible to assess the effect of null mutations, that is, mutations that substantially or completely eliminate one or more CCAT protein functions.

Detection and Diagnosis

The present invention provides a method for detecting CCAT nucleic acids, proteins, peptides and fragments thereof that are differentially expressed in colon diseases in a test sample, preferably in a biological sample.

The present invention further provides a method for diagnosing the colon diseases, by detecting the nucleic acids, proteins, peptides and fragments thereof. The further embodiment includes but is not limited to, monitoring the disease prognosis (recurrance), diagnosing disease stage, preventing the disease and treating the disease. While the protein is overexpressed, the expression of CCAT is preferably greater than about 20%, or preferably greater than about 30%, and most preferably greater than about 50% or more of normal colon sample; or at a level that is at least two fold, and preferably at least five fold, greater than the level of expression in control samples, as determined using a representative assay provided herein. While the protein is underexpressed, the expression of CCAT is preferably less than about 20%, or preferably less than 30%, and most preferably less than about 50% or less of the normal colon sample; or at a level that is at least 0.5 fold, and preferably at least 0.2 fold less than the level of the expression in control samples, as determined using a representative assay provided herein.

As used herein, a "biological sample" can be collected from tissues, blood, sera, cell lines or biological fluids. In one embodiment, a biological sample comprises cells or tissues suspected of having diseases (e.g., cells obtained from a biopsy).

As used herein, "biological fluids" are plasma, interstitial fluid, urine, cerebrospinal fluid, and the like, containing cells or proteins including shed proteins.

As used herein, a "differential level" is defined as the level of CCAT proteins or nucleic acids in a test sample either above or below the level of the ones in control samples, wherein the level of control samples is obtained either from a control cell line, a normal tissue or body fluids, or combination thereof, from a healthy subject.

As used herein, a "subject" can be a mammalian subject or non mammalian subject, preferably, a mammalian subject. A mammalian subject can be human or non-human, preferably human. A healthy subject is defined as a subject without detectable diseases or associated diseases by using conventional diagnostic methods.

As used herein the "diseases" include diseases and associated diseases. Preferably, the colon disease is color cancer.

As used herein, "cancer" includes epithelial-cell related cancers, for example pancreatic, lung, colon, prostate, ovarian, breast as well as bladder renal.

Nucleic Acid Detections

The present invention is not limited to the detection methods described above. Any suitable detection method that allows for the specific detection of colon disease cells, tissues or organs may be utilized. For example, in some embodiments, the expression of RNA corresponding to a CCAT gene is detected by hybridization to an antisense oligonucleotide (described below). In other embodiments, RNA expression is detected by hybridization assays such as Northern blots, RNase assays, reverse transcriptase PCR amplification, and the like. One preferred detection method is using RT PCR by using TAQMAN technology (ABI, Foster City, Calif.).

In another embodiment, the present invention provides a method for diagnosing or detecting colon diseases in a subject comprising: determining the level of one or more CCAT nucleic acid molecules or any fragment(s) thereof in a test sample from said subject, wherein said CCAT nucleic acid molecule(s) comprises a sequence selected from a group consisting of SEQ ID NOS: 684-1331 and a combination thereof; wherein a differential level of said CCAT nucleic acid molecule(s) relative to the level of said nucleic acid molecule(s) in a test sample from a healthy subject, or the level established for a healthy subject, is indicative of colon diseases.

In another embodiment, the detecting or diagnosing method comprises determining level of differential expression of 2, 4, 8, 10, 20 or more nucleic acid molecules, preferably, the nucleic acid molecules comprise or consists of a sequence selected from the group consisting of SEQ ID NOS: 684-1331 and combination thereof.

In further embodiments of the present invention, the presence of particular sequences in the genome of a subject is detected. Such sequences include CCAT sequences associated with abnormal expression of CCAT (e.g., overexpression or expression at a physiological inappropriate time). These sequences include polymorphisms, including polymorphisms in the transcribed sequence (e.g., that effect CCAT processing and/or translation) and regulatory sequences such as promoters, enhances, repressors, and the like. These sequences may also include polymorphisms in genes or control sequences associated with factors that affect expression such as transcription factors, and the like. Any suitable method for detecting and/or identifying these sequences is within the scope of the present invention including, but not limited to, nucleic acid sequencing, hybridization assays (e.g., Southern blotting), single nucleotide polymorphism assays (See e.g., U.S. Pat. No. 5,994,069, herein incorporated by reference in its entirety), and the like.

Protein Detections

The present invention provides methods for diagnosing or detecting the differential presence of CCAT protein. In some embodiments (e.g., where CCATs are overexpressed in diseased cells), CCAT proteins are detected directly. In other embodiments (e.g., where the presence of a CCATs are underexpressed), CCAT to the disease antigens are detected non-existence.

The diagnostic methods of the present invention find utility in the diagnosis and characterization of diseases. For example, the presence of an antibody to a specific protein may be indicative of a cancer or disease. In addition, certain CCAT may be indicative of a specific stage or sub-type of the same cancer or disease.

The information obtained is also used to determine prognosis and appropriate course of treatment. For example, it is contemplated that individuals with a specific CCAT expression or stage of colon diseases may respond differently to a given treatment that individuals lacking the CCAT expression. The information obtained from the diagnostic methods of the present invention thus provides for the personalization of diagnosis and treatment.

In one embodiment, the present invention provides a method for monitoring colon disease treatment in a subject comprising: determining the level of one or more CCAT proteins or any fragment(s) or peptide(s) thereof in a test sample from said subject, wherein said CCAT protein(s) comprises a sequence selected from a group consisting of SEQ ID NOS: 1-683, SEQ ID NOS: 1332-1501 and a combination thereof; wherein an level of said CCAT protein(s) similar to the level of said protein(s) in a test sample from a healthy subject, or the level established for a healthy subject, is indicative of successful treatment.

In another embodiment, the present invention provides a method for diagnosing recurrence of colon diseases following successful treatment in a subject comprising: determining the level of one or more CCAT proteins or any fragment(s) or peptide(s) thereof in a test sample from said subject, wherein said CCAT protein(s) comprises a sequence selected from a group consisting of SEQ ID NOS: 1-683, SEQ ID NOS: 1332-1501 or a combination thereof; wherein a changed level of said CCAT protein(s) relative to the level of said protein(s) in a test sample from a healthy subject, or the level established for a healthy subject, is indicative of recurrence of colon diseases.

In yet another embodiment, the present invention provides a method for diagnosing or detecting colon diseases in a subject comprising: determining the level of one or more CCAT proteins or any fragment(s) or peptides thereof in a test sample from said subject, wherein said CCAT protein(s) comprises a sequence selected from a group consisting of SEQ ID NOS: 1-683, SEQ ID NOS: 1332-1501 and a combination thereof; wherein a differential level of said CCAT protein(s) relative to the level of said protein(s) in a test sample from a healthy subject, or the level established for a healthy subject, is indicative of colon diseases.

The detecting or diagnosing method comprises determining level of differential expression of 2, 4, 8, 10, 20 or more proteins, preferably, the proteins are selected from a group consisting of SEQ ID NOS: 1-683 and combination thereof.

Further, the detecting or diagnosing method comprises determining level of differential expression of 5, 10, 15, 20, 40, 60, 80, 100 or more CCAT peptides, preferably the peptides are selected from the group consisting of SEQ ID NOS: 1332-1501 and combination thereof.

These methods are also useful for diagnosing diseases that show differential protein expression. As describe earlier, normal, control or standard values or level established from a healthy subject for protein expression are established by combining body fluids or tissue, cell extracts taken from a normal healthy mammalian or human subject with specific antibodies to a protein under conditions for complex formation. Standard values for complex formation in normal and diseased tissues are established by various methods, often photometric means. Then complex formation as it is expressed in a subject sample is compared with the standard values. Deviation from the normal standard and toward the diseased standard provides parameters for disease diagnosis or prognosis while deviation away from the diseased and toward the normal standard may be used to evaluate treatment efficacy.

In yet another embodiment, the present invention provides a detection or diagnostic method of CCATs by using LC/MS. The proteins from cells are prepared by methods known in the art (R. Aebersold Nature Biotechnology Volume 21 Number 6 Jun. 2003). The differential expression of proteins in disease and healthy samples are quantitated using Mass Spectrometry and ICAT (Isotope Coded Affinity Tag) labeling, which is known in the art. ICAT is an isotope label technique that allows for discrimination between two populations of proteins, such as a healthy and a disease sample. The LC/MS spectra are collected for the labeled samples. The raw scans from the LC/MS instrument are subjected to peak detection and noise reduction software. Filtered peak lists are then used to detect 'features' corresponding to specific peptides from the original sample(s). Features are characterized by their mass/charge, charge, retention time, isotope pattern and intensity.

The intensity of a peptide present in both healthy and disease samples can be used to calculate the differential expression, or relative abundance, of the peptide. The intensity of a peptide found exclusively in one sample can be used to calculate a theoretical expression ratio for that peptide (singleton). Expression ratios are calculated for each peptide of each replicate of the experiment (Table 1). Thus overexpression or under expression of CCAT protein or peptide are similar to the expression pattern in Table 1 in a test subject indicates the likelihood of having colon diseases or diseases associated with colon.

Immunological methods for detecting and measuring complex formation as a measure of protein expression using either specific polyclonal or monoclonal antibodies are known in the art. Examples of such techniques include enzyme-linked immunosorbent assays (ELISAs), radioimmunoassays (RIAs), fluorescence-activated cell sorting (FACS) and antibody arrays. Such immunoassays typically involve the measurement of complex formation between the protein and its specific antibody. These assays and their quantitation against purified, labeled standards are well known in the art (Ausubel, supra, unit 10.1-10.6). A two-site, monoclonal-based immunoassay utilizing antibodies reactive to two non-interfering epitopes is preferred, but a competitive binding assay may be employed (Pound (1998) Immunochemical Protocols, Humana Press, Totowa N.J.). More immunological detections are described in the sections below.

Antibody Detections

Antibodies are useful to detect the presence of one of the proteins or fragments thereof, peptides of the present invention in cells or tissues to determine the pattern of expression of the proteins among various tissues in an organism and over the course of normal development.

Further, as described above, the antibodies can be used to assess expression in disease states such as in active stages of the disease or in an individual with a predisposition toward disease related to the protein's function. The antibodies can also be used to assess normal and aberrant subcellular localization of cells in the various tissues in an organism.

Detection on a protein by an antibody can be facilitated by coupling (i.e., physically linking) the antibody to a detectable substance. Examples of detectable substances include various enzymes, prosthetic groups, fluorescent materials, luminescent materials, bioluminescent materials, and radioactive materials (see below). The antibodies may also be useful in diagnostic assays, e.g., for detecting expression of an antigen, for example CCAT protein, peptide or fragments thereof, in specific cells, tissues, blood, serum or body fluids.

For diagnostic applications, the antibody or its variant typically will be labeled with a detectable moiety. Numerous labels are available which can be generally grouped into the following categories:

(a) Radioisotopes, such as $^{36}S$, $^{14}C$, $^{125}I$, $^{3}H$, and $^{131}I$. The antibody variant can be labeled with the radioisotope using the techniques described in Current Protocols in Immunology, vol 1-2, Coligen et al., Ed., Wiley-Interscience, New York, Pubs. (1991) for example and radioactivity can be measured using scintillation counting.

(b) Fluorescent labels such as rare earth chelates (europium chelates) or fluorescein and its derivatives, rhodamine and its derivatives, dansyl, Lissamine, phycoerythrin and Texas Red are available. The fluorescent labels can be conjugated to the antibody variant using the techniques disclosed in Current Protocols in Immunology, supra, for example. Fluorescence can be quantified using a fluorimeter.

(c) Various enzyme-substrate labels are available and U.S. Pat. Nos. 4,275,149, and 4,318,980 provides a review of some of these. The enzyme generally catalyzes a chemical alteration of the chromogenic substrate which can be measured using various techniques. For example, the enzyme may catalyze a color change in a substrate, which can be measured spectrophotometrically. Alternatively, the enzyme may alter the fluorescence or chemiluminescence of the substrate. Techniques for quantifying a change in fluorescence are described above. The chemiluminescent substrate becomes electronically excited by a chemical reaction and may then emit light which can be measured (using a chemiluminometer, for example) or donates energy to a fluorescent acceptor. Examples of enzymatic labels include luciferases (e.g., firefly luciferase and bacterial luciferase; U.S. Pat. No. 4,737,456), luciferin, 2,3-dihydrophthalazinediones, malate dehydrogenase, urease, peroxidase such as horseradish peroxidase (HRPO), alkaline phosphatase, β-galactosidase, glucoamylase, lysozyme, saccharide oxidases (e.g., glucose oxidase, galactose oxidase, and glucose-6-phosphate dehydrogenase), heterocyclic oxidases (such as uricase and xanthine oxidase), lactoperoxidase, microperoxidase, and the like. Techniques for conjugating enzymes to antibodies are described in O'Sullivan et al., Methods for the Preparation of Enzyme-Antibody Conjugates for Use in Enzyme Immunoassay, in Methods in Enzyme. (Ed. J. Langone & H. Van Vunakis), Academic press, New York, 73: 147-166 (1981).

Sometimes, the label is indirectly conjugated with the antibody. The skilled artisan will be aware of various techniques for achieving this. For example, the antibody can be conjugated with biotin and any of the three broad categories of labels mentioned above can be conjugated with avidin, or vice versa. Biotin binds selectively to avidin and thus, the label can be conjugated with the antibody in this indirect manner. Alternatively, to achieve indirect conjugation of the label with the antibody, the antibody is conjugated with a small hapten (e.g. digloxin) and one of the different types of labels mentioned above is conjugated with an anti-hapten antibody (e.g. anti-digloxin antibody). Thus, indirect conjugation of the label with the antibody can be achieved.

In another embodiment of the invention, the antibody needs not be labeled, and the presence thereof can be detected using a labeled antibody, which binds to the antibody.

The antibodies of the present invention may be employed in any known assay method, such as competitive binding assays, direct and indirect sandwich assays, and immunoprecipitation assays. Zola, Monoclonal Antibodies: A Manual of Techniques, pp. 147-158 (CRC Press, Inc. 1987).

The biological samples can then be tested directly for the presence of CCAT by assays (e.g., ELISA or radioimmunoassay) and format (e.g., microwells, dipstick (e.g., as described in International Patent Publication WO 93/03367), etc). Alternatively, proteins in the sample can be size separated (e.g., by polyacrylamide gel electrophoresis (PAGE)), in the presence or absence of sodium dodecyl sulfate (SDS), and the presence of CCAT detected by immunoblotting (e.g., Western blotting). Immunoblotting techniques are generally more effective with antibodies generated against a peptide corresponding to an epitope of a protein, and hence, are particularly suited to the present invention.

Antibody binding is detected by techniques known in the art (e.g., radioimmunoassay, ELISA (enzyme-linked immunosorbant assay), "sandwich" immunoassays, immunoradiometric assays, gel diffusion precipitation reactions, immunodiffusion assays, in situ immunoassays (e.g., using colloidal gold, enzyme or radioisotope labels, for example), Western blots, precipitation reactions, agglutination assays (e.g., gel agglutination assays, hemagglutination assays, etc.), complement fixation assays, immunofluorescence assays, protein A assays, and immunoelectrophoresis assays, etc.

In one embodiment, antibody binding is detected by detecting a label on the primary antibody. In another embodiment, the primary antibody is detected by detecting binding of a secondary antibody or reagent to the primary antibody. In a further embodiment, the secondary antibody is labeled. Many means are known in the art for detecting binding in an immunoassay and are within the scope of the present invention. As is well known in the art, the immunogenic peptide should be provided free of the carrier molecule used in any immunization protocol. For example, if the peptide was conjugated to KLH, it may be conjugated to BSA, or used directly, in a screening assay. In some embodiments, an automated detection assay is utilized. Methods for the automation of immunoassays are well known in the art (See e.g., U.S. Pat. Nos. 5,885,530, 4,981,785, 6,159,750, and 5,358,691, each of which is herein incorporated by reference). In some embodiments, the analysis and presentation of results is also automated. For example, in some embodiments, software that generates a prognosis based on the presence or absence of a series of antigens is utilized.

Competitive binding assays rely on the ability of a labeled standard to compete with the test sample for binding with a limited amount of antibody. The amount of antigen in the test sample is inversely proportional to the amount of standard that becomes bound to the antibodies. To facilitate determining the amount of standard that becomes bound, the antibodies generally are insolubilized before or after the competition. As a result, the standard and test sample that are bound to the antibodies may conveniently be separated from the standard and test sample, which remain unbound.

Sandwich assays involve the use of two antibodies, each capable of binding to a different immunogenic portion, or epitope, or the protein to be detected. In a sandwich assay, the test sample to be analyzed is bound by a first antibody, which is immobilized on a solid support, and thereafter a second antibody binds to the test sample, thus forming an insoluble three-part complex. See e.g., U.S. Pat. No. 4,376,110. The second antibody may itself be labeled with a detectable moiety (direct sandwich assays) or may be measured using an anti-immunoglobulin antibody that is labeled with a detectable moiety (indirect sandwich assay). For example, one type of sandwich assay is an ELISA assay, in which case the detectable moiety is an enzyme.

The antibodies may also be used for in vivo diagnostic assays. Generally, the antibody is labeled with a radionucleotide (such as $^{111}$In, $^{99}$Tc, $^{14}$C, $^{131}$I, $^{3}$H, $^{32}$P or $^{35}$S) so that the tumor can be localized using immunoscintiography. In one embodiment, antibodies or fragments thereof bind to the extracellular domains of two or more CCAT targets and the affinity value (Kd) is less than $1\times10^8$ M Antibodies for diagnostic use may be labeled with probes suitable for detection by various imaging methods. Methods for detection of probes include, but are not limited to, fluorescence, light, confocal and electron microscopy; magnetic resonance imaging and spectroscopy; fluoroscopy, computed tomography and positron emission tomography. Suitable probes include, but are not limited to, fluorescein, rhodamine, eosin and other fluorophores, radioisotopes, gold, gadolinium and other lanthanides, paramagnetic iron, fluorine-18 and other positron-emitting radionuclides. Additionally, probes may be bi- or multi-functional and be detectable by more than one of the methods listed. These antibodies may be directly or indirectly labeled with said probes. Attachment of probes to the antibodies includes covalent attachment of the probe, incorporation of the probe into the antibody, and the covalent attachment of a chelating compound for binding of probe, amongst others well recognized in the art.

For immunohistochemistry, the disease tissue sample may be fresh or frozen or may be embedded in paraffin and fixed with a preservative such as formalin (see Examples). The fixed or embedded section contains the sample are contacted with a labeled primary antibody and secondary antibody, wherein the antibody is used to detect the CCAT protein express in situ. The detailed procedure is shown in the Example.

Array:

"Array" refers to an ordered arrangement of at least two transcripts, proteins or peptides, or antibodies on a substrate. At least one of the transcripts, proteins, or antibodies represents a control or standard, and the other transcript, protein, or antibody is of diagnostic or therapeutic interest. The arrangement of at least two and up to about 40,000 transcripts, proteins, or antibodies on the substrate assures that the size and signal intensity of each labeled complex, formed between each transcript and at least one nucleic acid, each protein and at least one ligand or antibody, or each antibody and at least one protein to which the antibody specifically binds, is individually distinguishable.

An "expression profile" is a representation of gene expression in a sample. A nucleic acid expression profile is produced using sequencing, hybridization, or amplification technologies using transcripts from a sample. A protein expression profile, although time delayed, minors the nucleic acid expression profile and is produced using gel electrophoresis, mass spectrometry, or an array and labeling moieties or antibodies which specifically bind the protein. The nucleic acids, proteins, or antibodies specifically binding the protein may be used in solution or attached to a substrate, and their detection is based on methods well known in the art.

A substrate includes but not limited to, paper, nylon or other type of membrane, filter, chip, glass slide, or any other suitable solid support.

The invention also provides an array with a cDNA or transcript encoding CCAT proteins or peptides or fragments thereof, antibodies that specifically bind CCAT proteins, peptides or fragments thereof. Preferably, two or more of the nucleic acid molecules (e.g., SEQ ID NOS: 684-1331), proteins (e.g., SEQ ID NOS: 1-683) or peptides (e.g., SEQ ID NOS: 1332-1501) are immobilized on a substrate. Specifically, the following targets are selected for targeting purpose: DPEP-1, Prominin-1, Integrin beta-4, Leukocyte Elastase, Defensin alpha 1, oligosaccharyl transferase 3, Wolframin, Ectonucleoside triphosphate diphosphohydrolase 2, T-cell surface glycoprotein CD5.

The present invention also provides an antibody array. Antibody arrays have allowed the development of techniques for high-throughput screening of recombinant antibodies. Such methods use robots to pick and grid bacteria containing antibody genes, and a filter-based ELISA to screen and identify clones that express antibody fragments. Because liquid handling is eliminated and the clones are arrayed from master stocks, the same antibodies can be spotted multiple times and screened against multiple antigens simultaneously. For more information, see de Wildt et al. (2000) Nat Biotechnol 18:989-94.

The array is prepared and used according to the methods described in U.S. Pat. No. 5,837,832, Chee et al., PCT application WO95/11995 (Chee et al.), Lockhart, D. J. et al. (1996; Nat. Biotech. 14: 1675-1680) and Schena, M. et al. (1996; Proc. Natl. Acad. Sci. 93: 10614-10619), U.S. Pat. No. 5,807,522, Brown et al., all of which are incorporated herein in their entirety by reference.

In one embodiment, a nucleic acid array or a microarray, preferably composed of a large number of unique, single-stranded nucleic acid sequences, usually either synthetic antisense oligonucleotides or fragments of cDNAs, fixed to a solid support. The oligonucleotides are preferably about 6-60 nucleotides in length, more preferably 15-30 nucleotides in length, and most preferably about 20-25 nucleotides in length.

In order to produce oligonucleotides to a known sequence for an array, the gene(s) of interest (or an ORF identified from the contigs of the present invention) is typically examined using a computer algorithm which starts at the 5' or at the 3' end of the nucleotide sequence. Typical algorithms will then identify oligomers of defined length that are unique to the gene, have a GC content within a range suitable for hybridization, and lack predicted secondary structure that may interfere with hybridization. In certain situations it may be appropriate to use pairs of oligonucleotides on an array. The "pairs" will be identical, except for one nucleotide that preferably is located in the center of the sequence. The second oligonucleotide in the pair (mismatched by one) serves as a control. The number of oligonucleotide pairs may range from two to one million. The oligomers are synthesized at designated areas on a substrate using a light-directed chemical process, wherein the substrate may be paper, nylon or other type of membrane, filter, chip, glass slide or any other suitable solid support as described above.

In another aspect, an oligonucleotide may be synthesized on the surface of the substrate by using a chemical coupling procedure and an ink jet application apparatus, as described in PCT application WO95/251116 (Baldeschweiler et al.) which is incorporated herein in its entirety by reference.

A gene expression profile comprises the expression of a plurality of transcripts as measured by after hybridization with a sample. The transcripts of the invention may be used as elements on an array to produce a gene expression profile. In one embodiment, the array is used to diagnose or monitor the progression of disease. Researchers can assess and catalog the differences in gene expression between healthy and diseased tissues or cells.

For example, the transcript or probe may be labeled by standard methods and added to a biological sample from a patient under conditions for the formation of hybridization complexes. After an incubation period, the sample is washed and the amount of label (or signal) associated with hybridization complexes, is quantified and compared with a standard value. If complex formation in the patient sample is significantly altered (higher or lower) in comparison to either a normal or disease standard, then differential expression indicates the presence of a disorder.

In order to provide standards for establishing differential expression, normal and disease expression profiles are established. This is accomplished by combining a sample taken from normal subjects, either animal or human or nonmammal, with a transcript under conditions for hybridization to occur. Standard hybridization complexes may be quantified by comparing the values obtained using normal subjects with values from an experiment in which a known amount of a purified sequence is used. Standard values obtained in this manner may be compared with values obtained from samples from patients who were diagnosed with a particular condition, disease, or disorder. Deviation from standard values toward those associated with a particular disorder is used to diagnose that disorder.

By analyzing changes in patterns of gene/protein expression, disease can be diagnosed at earlier stages before the patient is symptomatic. The invention can be used to formulate a prognosis and to design a treatment regimen. The invention can also be used to monitor the efficacy of treatment. For treatments with known side effects, the array is employed to improve the treatment regimen. A dosage is established that causes a change in genetic expression patterns indicative of successful treatment. Expression patterns associated with the onset of undesirable side effects are avoided.

In another embodiment, animal models which mimic a human disease can be used to characterize expression profiles associated with a particular condition, disease, or disorder; or treatment of the condition, disease, or disorder. Novel treatment regimens may be tested in these animal models using arrays to establish and then follow expression profiles over time. In addition, arrays may be used with cell cultures or tissues removed from animal models to rapidly screen large numbers of candidate drug molecules, looking for ones that produce an expression profile similar to those of known therapeutic drugs, with the expectation that molecules with the same expression profile will likely have similar therapeutic effects. Thus, the invention provides the means to rapidly determine the molecular mode of action of a drug.

Such assays may also be used to evaluate the efficacy of a particular therapeutic treatment regimen in animal studies or in clinical trials or to monitor the treatment of an individual patient. Once the presence of a condition is established and a treatment protocol is initiated, diagnostic assays may be repeated on a regular basis to determine if the level of expression in the patient begins to approximate that which is observed in a normal subject. The results obtained from successive assays may be used to show the efficacy of treatment over a period ranging from several days to years.

In one embodiment, the detected targets comprise, consist essentially of or consist of combinations of CCAT proteins or nucleic acids encoding such proteins. The combinations are either 2, 3, 4, 5, 6, 7, 8, 9, 10, 15, 20, 25, 30, 35, 40, 50, 60, 70, 80, 90, 100, 150, 200, 250 proteins (SEQ ID NOS: 1-683), nucleic acids (SEQ ID NOS: 684-1331) encoding such proteins, or peptides (SEQ ID NOS: 1332-1501).

In one embodiment, the protein or nucleic acid targets for detection of colon cancer comprise targets selected from a group consisting of DPEP-1, Prominin-1, Integrin beta-4, Leukocyte Elastase, Defensin alpha 1, oligosaccharyl transferase 3, Wolframin, Ectonucleoside triphosphate diphosphohydrolase 2, T-cell surface glycoprotein CD5 and combination thereof, wherein their corresponding sequences are listed in Table 1.

In another embodiment, the detection targets are combination of all the targets of DPEP-1, Prominin-1, Integrin beta-4, Leukocyte Elastase, Defensin alpha 1, oligosaccharyl transferase 3, Wolframin, Ectonucleoside triphosphate diphosphohydrolase 2, T-cell surface glycoprotein CD5.

In yet another embodiment, the invention provides a composition comprising a plurality of CCAT nucleic acid sequences for use in detecting the differential expression of genes in a disease state, wherein said plurality of nucleic acid sequences comprise two or more sequences of SEQ ID NOS: 684-1331, or all the sequences of SEQ ID NOS: 684-1331, or the complete complements thereof. Further, the nucleic acid sequences are immobilized on a substrate, and the said nucleic acid sequences are hybridizable elements on a microarray.

In yet another embodiment, the invention provides a composition comprising a plurality of CCAT proteins or peptides for use in detecting the differential expression of proteins in a disease state wherein said plurality of protein sequences comprise two or more sequences of SEQ ID NOS: 1-683 or all sequence of SEQ ID NOS: 1-683; and wherein said plurality of peptide sequences comprise two or more sequences of SEQ ID NOS: 1332-1501 or all sequence of SEQ ID NOS: 1332-1501.

In yet another embodiment, the compositions can be used in diagnosing or monitoring the treatment of colon cancer Treatment The following terms, as used in the present specification and claims, are intended to have the meaning as defined below, unless indicated otherwise.

"Treat," "treating" or "treatment" of a disease includes: (1) inhibiting the disease, i.e., arresting or reducing the development of the disease or its clinical symptoms, or (2) relieving the disease, i.e., causing regression of the disease or its clinical symptoms.

A "therapeutically effective amount" means the amount of an agent that, when administered to a subject for treating a disease, is sufficient to effect such treatment for the disease. The "therapeutically effective amount" will vary depending on the agent, the disease and its severity and the age, weight, etc., of the subject to be treated.

A "Colon or colorectal disease" includes but not limited to colon cancer, colon tumor, diverticulosis, diverticulitis, Crohn's disease, ulcerative colitis, irritable bowel syndrome, inflammatory bowel disease, hemorrhoids, and anal fissure.

A "cancer" is epithelial-cell related cancers including, but not limited to, pancreatic, lung, colon, prostate, ovarian, breast as well as, bladder and renal, hepatocellular, pharyngeal and gastric cancer.

The present invention provides an application of treatment by using antibody, immunogenic peptides as well as other CCAT agonists or antagonists.

CCATs are proteins differentially expressed in the colon diseases cell lines or tissues. The proteins are either cell surface proteins or cytosolic proteins (see the list in Table 1). These proteins are associated with the diseases especially colon diseases, particularly colon cancer; thus, they serve as candidate targets for the treatment of the diseases.

In one embodiment, when decreased expression or activity of the protein is desired, an inhibitor, antagonist, antibody and the like or a pharmaceutical agent containing one or more of these molecules may be delivered. Such delivery may be effected by methods well known in the art and may include delivery by an antibody specifically targeted to the protein. Neutralizing antibodies, which inhibit dimer formation, are generally preferred for therapeutic use.

In another embodiment, when increased expression or activity of the protein is desired, the protein, an agonist, an enhancer and the like or a pharmaceutical agent containing one or more of these molecules may be delivered. Such delivery may be effected by methods well known in the art and may include delivery of a pharmaceutical agent by an antibody specifically targeted to the protein.

Any of the transcripts, complementary molecules, or fragments thereof, proteins or portions thereof, vectors delivering these nucleic acid molecules or expressing the proteins, and their ligands may be administered in combination with other therapeutic agents. Selection of the agents for use in combination therapy may be made by one of ordinary skill in the art according to conventional pharmaceutical principles. A combination of therapeutic agents may act synergistically to affect treatment of a particular disorder at a lower dosage of each agent.

Antibody Therapy

The antibody of the present invention can be used for therapeutic reason. It is contemplated that the antibody of the present invention may be used to treat a mammal, preferably human with colon diseases.

In general, the antibodies are also useful for inhibiting protein function, for example, blocking the binding of the CCAT protein or peptide to a binding partner such as a substrate. These uses can also be applied in a therapeutic context in which treatment involves inhibiting the protein's function. An antibody can be used, for example, to block binding, thus modulating (agonizing or antagonizing) the peptides activity. Antibodies can be prepared against specific fragments containing sites required for function or against intact protein that is associated within a cell or cell membrane. The function blocking assays are provided in detail in the Examples. Other evidence is provided in U.S. Pat. No. 6,207,152, and U.S. Pat. No. 6,387,371.

The antibodies of present invention can also be used as means of enhancing the immune response. The antibodies can be administered in amounts similar to those used for other therapeutic administrations of antibody. For example, pooled gamma globulin is administered at a range of about 1 mg to about 100 mg per patient. Thus, antibodies reactive with the protein or peptides of CCAT can be passively administered alone or in conjunction with other anti-cancer therapies to a mammal afflicted with colon diseases or cancer. Examples of anti-cancer therapies include, but are not limited to, chemotherapy, radiation therapy, adoptive immunotherapy therapy with TIL (Tumor Infiltration Lymphocytes).

The selection of an antibody subclass for therapy will depend upon the nature of the disease tumor antigen. For example, an IgM may be preferred in situations where the antigen is highly specific for the diseased target and rarely occurs on normal cells. However, where the disease-associated antigen is also expressed in normal tissues, although at much lower levels, the IgG subclass may be preferred for the following reason: since the binding of at least two IgG molecules in close proximity is required to activate complement, less complement mediated damage may occur in the normal tissues which express smaller amounts of the antigen and, therefore, bind fewer IgG antibody molecules. Furthermore, IgG molecules by being smaller may be more able than IgM molecules to localize to the diseased tissue.

The mechanism for antibody therapy is that the therapeutic antibody recognizes a cell surface protein or a cytosolic protein that is overexpressed in diseased cells. By NK cell or complement activation, conjugation of the antibody with an immunotoxin or radiolabel, the interaction can abrogate ligand/receptor interaction or activation of apoptosis.

The potential mechanisms of antibody-mediated cytotoxicity of diseased cells are phagocyte (antibody dependent cellular cytotoxicity (ADCC)) (see Example), complement (Complement-mediated cytotoxicity (CMC)) (see Example), naked antibody (receptor cross-linking apoptosis and growth factor inhibition), or targeted payload labeled with radionuclide or immunotoxins or immunochemotherapeutics.

In one embodiment, the antibody is administered to a nonhuman mammal for the purposes of obtaining preclinical data, for example. Exemplary nonhuman mammals to be treated include nonhuman primates, dogs, cats, rodents and other mammals in which preclinical studies are performed. Such mammals may be established animal models for a disease to be treated with the antibody or may be used to study toxicity of the antibody of interest. In each of these embodiments, dose escalation studies may be performed on the mammal.

The antibody is administered by any suitable means, including parenteral, subcutaneous, intraperitoneal, intrapulmonary, and intranasal, and, if desired for local immunosuppressive treatment, intralesional administration. Parenteral infusions include intramuscular, intravenous, intraarterial, intraperitoneal, or subcutaneous administration. In addition, the antibody variant is suitably administered by pulse infusion, particularly with declining doses of the antibody variant. Preferably the dosing is given by injections, most preferably intravenous or subcutaneous injections, depending in part on whether the administration is brief or chronic.

For the prevention or treatment of a disease, the appropriate dosage of the antibody will depend on the type of disease to be treated, the severity and the course of the disease, whether the antibody is administered for preventive or therapeutic purposes, previous therapy, the patient's clinical history and response to the antibody, and the discretion of the attending physician.

Depending on the type and severity of the disease, about 1 mug/kg to 150 mg/kg (e.g., 0.1-20 mg/kg) of antibody is an initial candidate dosage for administration to the patient, whether, for example, by one or more separate administrations, or by continuous infusion. A typical daily dosage might range from about 1.mu.g/kg to 100 mg/kg or more, depending on the factors mentioned above. For repeated administrations over several days or longer, depending on the condition, the treatment is sustained until a desired suppression of disease symptoms occurs. However, other dosage regimens may be useful. The progress of this therapy is easily monitored by conventional techniques and assays.

The antibody composition will be formulated, dosed and administered in a manner consistent with good medical practice. Factors for consideration in this context include the particular disorder being treated, the particular mammal being treated, the clinical condition of the individual patient, the cause of the disorder, the site of delivery of the agent, the method of administration, the scheduling of administration, and other factors known to medical practitioners.

The therapeutically effective amount of the antibody to be administered will be governed by such considerations, and is the minimum amount necessary to prevent, ameliorate, or treat a disease or disorder. The antibody need not be, but is optionally formulated with one or more agents currently used to prevent or treat the disorder in question.

Antibodies of the present invention may also be used as therapeutic reagents, to diminish or eliminate cancer or tumors. For example, the antibodies may be used on their own (for instance, to inhibit metastases) or coupled to one or more therapeutic agents. Suitable agents in this regard include radionuclides, differentiation inducers, drugs, toxins, and derivatives thereof. Preferred radionuclides include $^{90}Y$, $^{123}I$, $^{125}I$, $^{131}I$, $^{188}Re$, $^{211}At$, and $^{212}Bi$. Preferred drugs include methotrexate, and pyrimidine and purine analogs. Preferred differentiation inducers include phorbol esters and butyric acid. Preferred toxins include ricin, abrin, diptheria toxin, cholera toxin, gelonin, *Pseudomonas exotoxin, Shigella* toxin, and pokeweed antiviral protein.

A therapeutic agent may be coupled (e.g., covalently bonded) to a suitable monoclonal antibody either directly or indirectly (e.g., via a linker group). A direct reaction between an agent and an antibody is possible when each possesses a substituent capable of reacting with the other. For example, a nucleophilic group, such as an amino or sulfhydryl group, on one may be capable of reacting with a carbonyl-containing group, such as an anhydride or an acid halide, or with an alkyl group containing a good leaving group (e.g., a halide) on the other.

Alternatively, it may be desirable to couple a therapeutic agent and an antibody via a linker group. A linker group can function as a spacer to distance an antibody from an agent in order to avoid interference with binding capabilities. A linker group can also serve to increase the chemical reactivity of a substituent on an agent or an antibody, and thus increase the coupling efficiency. An increase in chemical reactivity may also facilitate the use of agents, or functional groups on agents, which otherwise would not be possible.

It will be evident to those skilled in the art that a variety of bifunctional or polyfunctional reagents, both homo- and hetero-functional (such as those described in the catalog of the Pierce Chemical Co., Rockford, Ill.), may be employed as the linker group. Coupling may be affected, for example, through amino groups, carboxyl groups, sulfhydryl groups or oxidized carbohydrate residues. There are numerous references describing such methodology, e.g. U.S. Pat. No. 4,671,958, to Rodwell et al.

Where a therapeutic agent is more potent when free from the antibody portion of the immunoconjugates of the present invention, it may be desirable to use a linker group which is cleavable during or upon internalization into a cell. A number of different cleavable linker groups have been described. The mechanisms for the intracellular release of an agent from these linker groups include cleavage by reduction of a disulfide bond (e.g., U.S. Pat. No. 4,489,710, to Spitler), by irradiation of a photolabile bond (e.g., U.S. Pat. No. 4,625,014, to Senter et al.), by hydrolysis of derivatized amino acid side chains (e.g., U.S. Pat. No. 4,638,045, to Kohn et al.), by serum complement-mediated hydrolysis (e.g., U.S. Pat. No. 4,671,958, to Rodwell et al.), and acid-catalyzed hydrolysis (e.g., U.S. Pat. No. 4,569,789, to Blattler et al.).

It may be desirable to couple more than one agent to an antibody. In one embodiment, multiple molecules of an agent are coupled to one antibody molecule. In another embodiment, more than one type of agent may be coupled to one antibody. Regardless of the particular embodiment, immunoconjugates with more than one agent may be prepared in a variety of ways as described above.

While it is possible for the immunogen to be administered in a pure or substantially pure form, it is preferable to present it as a pharmaceutical composition, formulation or preparation with a carrier.

The formulations of the present invention, both for veterinary and for human use, comprise an immunogen as described above, together with one or more pharmaceutically acceptable carriers and, optionally, other therapeutic ingredients. The carrier(s) must be "acceptable" in the sense of being compatible with the other ingredients of the formulation and not deleterious to the recipient thereof. The formulations may conveniently be presented in unit dosage form and may be prepared by any method well-known in the pharmaceutical art.

Suitable pharmaceutical carriers include proteins such as albumins (e.g., U.S. Pat. No. 4,507,234, to Kato et al.), peptides and polysaccharides such as aminodextran (e.g., U.S. Pat. No. 4,699,784, to Shih et al.), or water. A carrier may also bear an agent by noncovalent bonding or by encapsulation, such as within a liposome vesicle (e.g., U.S. Pat. Nos. 4,429,008 and 4,873,088). Carriers specific for radionuclide agents include radiohalogenated small molecules and chelating compounds. For example, U.S. Pat. No. 4,735,792 discloses representative radiohalogenated small molecules and their synthesis. A radionuclide chelate may be formed from chelating compounds that include those containing nitrogen and sulfur atoms as the donor atoms for binding the metal, metal oxide, radionuclide. For example, U.S. Pat. No. 4,673,562, to Davison et al. discloses representative chelating compounds and their synthesis.

All methods include the step of bringing into association the active ingredient with the carrier, which constitutes one or more accessory ingredients. In general, the formulations are prepared by uniformly and intimately bringing into association the active ingredient with liquid carriers or finely divided solid carriers or both, and then, if necessary, shaping the product into the desired formulation.

Formulations suitable for intravenous intramuscular, subcutaneous, or intraperitoneal administration conveniently comprise sterile aqueous solutions of the active ingredient with solutions, which are preferably isotonic with the blood of the recipient. Such formulations may be conveniently prepared by dissolving solid active ingredient in water containing physiologically compatible substances such as sodium chloride (e.g. 0.1-2.0M), glycine, and the like, and having a buffered pH compatible with physiological conditions to produce an aqueous solution, and rendering said solution sterile. These may be present in unit or multi-dose containers, for example, sealed ampoules or vials.

The formulations of the present invention may incorporate a stabilizer. Illustrative stabilizers are polyethylene glycol, proteins, saccharides, amino acids, inorganic acids, and organic acids, which may be used either on their own or as admixtures. These stabilizers are preferably incorporated in an amount of 0.11-10,000 parts by weight per part by weight of immunogen. If two or more stabilizers are to be used, their total amount is preferably within the range specified above. These stabilizers are used in aqueous solutions at the appropriate concentration and pH. The specific osmotic pressure of such aqueous solutions is generally in the range of 0.1-3.0 osmoles, preferably in the range of 0.8-1.2. The pH of the aqueous solution is adjusted to be within the range of 5.0-9.0, preferably within the range of 6-8. In formulating the antibody of the present invention, anti-adsorption agent may be used.

Additional pharmaceutical methods may be employed to control the duration of action. Controlled release preparations may be achieved through the use of polymer to complex or absorb the proteins or their derivatives. The controlled delivery may be exercised by selecting appropriate macromolecules (for example polyester, polyamino acids, polyvinyl, pyrrolidone, ethylenevinylacetate, methylcellulose, carboxymethylcellulose, or protamine sulfate) and the concentration of macromolecules as well as the methods of incorporation in order to control release. Another possible method to control the duration of action by controlled-release preparations is to incorporate the CCAT antibody into particles of a polymeric material such as polyesters, polyamino acids, hydrogels, poly(lactic acid) or ethylene vinylacetate copolymers. Alternatively, instead of incorporating these agents into polymeric particles, it is possible to entrap these materials in microcapsules prepared, for example, by coacervation techniques or by interfacial polymerization, for example, hydroxymethylcellulose or gelatin-microcapsules and poly (methylmethacylate) microcapsules, respectively, or in colloidal drug delivery systems, for example, liposomes, albumin microspheres, microemulsions, nanoparticles, and nanocapsules or in macroemulsions.

When oral preparations are desired, the compositions may be combined with typical carriers, such as lactose, sucrose, starch, talc magnesium stearate, crystalline cellulose, methyl cellulose, carboxymethyl cellulose, glycerin, sodium alginate or gum arabic among others.

The therapeutic antibody may be supplied in the form of a kit, alone, or in the form of a pharmaceutical composition as described above.

Other Immunotherapy

The CCAT proteins or peptides or fragments thereof of this invention are also intended for use in producing antiserum designed for pre- or post-disease prophylaxis. Here the protein, peptides or fragment thereof, is formulated with a suitable adjuvant and administered by injection to human volunteers, according to known methods for producing human antisera. Antibody response to the injected proteins is monitored, during a several-week period following immunization, by periodic serum sampling to detect the presence of antiserum antibodies, using an immunoassay as described herein.

The antiserum from immunized individuals may be administered as a prophylactic measure for individuals who are at risk of developing colon diseases or cancer. The antiserum is also useful in treating an individual afflicted with colon diseases or cancer for post-disease prophylaxis.

Alternatively, peptides derived form the CCAT protein sequence may be modified to increase their immunogenicity by enhancing binding of the peptide to the MHC molecules in which the peptide is presented. The peptide or modified peptide may be conjugated to a carrier molecule to enhance the antigenicity of the peptide. Examples of carrier molecules, include, but are not limited to, human albumin, bovine albumin, lipoprotein and keyhole limpet hemo-cyanin ("Basic and Clinical Immunology" (1991) Stites, D. P. and Ten A. I. (eds) Appleton and Lange, Norwalk Conn., San Mateo, Calif.).

An "immunogenic peptide" is a peptide, which comprises an allele-specific motif such that the peptide will bind the MHC allele (HLA in human) and be capable of inducing a CTL (cytoxic T-lymphocytes) response. Thus, immunogenic peptides are capable of binding to an appropriate class I or II MHC molecule and inducing a cytotoxic T cell or T helper cell response against the antigen from which the immunogenic peptide is derived.

Alternatively, amino acid sequence variants of the peptide can be prepared by mutations in the DNA, which encodes the peptide, or by peptide synthesis.

At the genetic level, these variants ordinarily are prepared by site-directed mutagenesis of nucleotides in the DNA encoding the peptide molecule, thereby producing DNA encoding the variant, and thereafter expressing the DNA in recombinant cell culture. The variants typically exhibit the same qualitative biological activity as the nonvariant peptide.

T-lymphocytes recognize antigen in association with Class I or Class II MHC molecules in the form of a peptide fragment bound to an MHC molecule. The degree of peptide binding to a given MHC allele is based on amino acids at particular positions within the peptide (Parker et al. (1992) Journal of Immunology 149:3580; Kubo, et al. (1994) Journal of Immunology 52:3913-3924; Ruppert J. et al. (1993) Cell 74:929-937; Falk et al. (1991) Nature 351:290-296). The peptides of the present invention are useful as an epitope for immunogenic response (see more detailed description below).

In human, MHC is called HLA, wherein class I molecules are encoded by the HLA-A, B, and C loci. HLA-A and B antigens are expressed at the cell surface at approximately equal densities, whereas the expression of HLA-C is significantly lower (about 10-fold lower). Each of these loci has a number of alleles. MHC class II molecules are encoded by three pairs of MHC II alpha- and beta-chain genes, called HLA DR, -DP, and -DQ in human. In many haplotypes the HLA-DR cluster contains an extra beta-chain gene whose product can pair with the DR alpha chain. Each MHC class I and II molecule binds a different rage of peptides. The present of several loci means that any one individual is equipped to present a much broader ranger of different peptides than if only one MHC protein of each class were expressed at the cell surface. The peptide binding motifs of the present invention are designed to be specific for each allelic subtype.

The peptides of the present invention are used for treatment of the colon diseases. Treatment involves administration of the protective composition after the appearance of the disease.

The present invention is also applied to prevent and suppress the disease. It is not always possible to distinguish between "preventing" and "suppressing" since the ultimate inductive event or events may be unknown, latent, or the patient is not ascertained until well after the occurrence of the event or events. Therefore, it is common to use the term "prophylaxis" as distinct from "treatment" to encompass both "preventing" and "suppressing" as defined herein. The term "protection," as used herein, is meant to include "prophylaxis."

The peptides are used for treating T cell-mediated pathology. The term "T cell-mediated pathology" refers to any condition in which an inappropriate T cell response is a component of the pathology. The term is intended to encompass both T cell mediated colon diseases and diseases resulting from unregulated clonal T cell replication.

Therefore, the present invention relates to peptides or modified peptides derived from the protein sequences of the CCAT proteins that differentially expressed in the colon diseases. By way of example, modification may include substitution, deletion or addition of an amino acid in the given immunogenic peptide sequence or mutation of existing amino acids within the given immunogenic peptide sequence, or derivatization of existing amino acids within the given immunogenic peptide sequence. Any amino acid comprising the immunogenic peptide sequence may be modified in accordance with this invention. In one aspect, at least one amino acid is substituted or replaced within the given immunogenic peptide sequence. Any amino acid may be used to substitute or replace a given amino acid within the immunogenic peptide sequence. Modified peptides are intended to include any immunogenic peptide obtained from differentially expressed proteins, which has been modified and exhibits enhanced binding to the MHC molecule with which it associates when presented to the T-cell. These modified peptides may be synthetically or recombinantly produced by conventional methods.

In another embodiment, the peptides of the present invention comprise, or consisiting sequences of about 5-8, 8-10, 10-15 or 15-30 amino acids which are immunogenic, that is, capable of inducing an immune response when injected into a subject.

The recombinant or natural protein, peptides, or fragment thereof of CCAT, or modified peptides, may be used as a vaccine either prophylactically or therapeutically. When provided prophylactically the vaccine is provided in advance of any evidence of colon diseases, particularly, cancer. The prophylactic administration of the colon disease vaccine should serve to prevent or attenuate colon diseases, preferably cancer, in a mammal.

Preparation of vaccine is using recombinant protein or peptide expression vectors comprising all or part of nucleic acid sequence of CCAT proteins encoding peptides. Examples of vectors that may be used in the aforementioned vaccines include, but are not limited to, defective retroviral vectors, adenoviral vectors vaccinia viral vectors, fowl pox viral vectors, or other viral vectors (Mulligan, R. C., (1993) Science 260:926-932). The viral vectors carrying all or part of nucleic sequence of SEQ ID NOS: 684-1331 can be introduced into a mammal either prior to any evidence of colon diseases or to mediate regression of the disease in a mammal afflicted with colon diseases. Examples of methods for administering the viral vector into the mammals include, but are not limited to, exposure of cells to the virus ex vivo, or injection of the retrovirus or a producer cell line of the virus into the affected tissue or intravenous administration of the virus. Alternatively the viral vector carrying all or part of the CCAT nucleic acid sequence that encode peptides may be administered locally by direct injection into the cancer lesion or topical application in a pharmaceutically acceptable carrier. The quantity of viral vector, carrying all or part of the CCAT nucleic acid sequence, to be administered is based on the titer of virus particles. A preferred range of the immunogen to be administered may be about 106 to about 1011 virus particles per mammal, preferably a human. After immunization the efficacy of the vaccine can be assessed by production of antibodies or immune cells that recognize the antigen, as assessed by specific lytic activity or specific cytokine production or by tumor regression. One skilled in the art would know the conventional methods to assess the aforementioned parameters. If the mammal to be immunized is already afflicted with cancer, the vaccine can be administered in conjunction with other therapeutic treatments. Examples of other therapeutic treatments includes, but are not limited to, adoptive T cell immunotherapy, coadministration of cytokines or other therapeutic drugs for cancer.

Alternatively all or parts thereof of a substantially or partially purified CCAT protein or their peptides may be administered as a vaccine in a pharmaceutically acceptable carrier. Ranges of the protein that may be administered are about 0.001 to about 100 mg per patient, preferred doses are about 0.01 to about 100 mg per patient. In a preferred embodiment, the peptides or modified peptides thereof is administered therapeutically or prophylactically to a mammal in need of such treatment. The peptide may be synthetically or recombinantly produced. Immunization is repeated as necessary, until a sufficient titer of anti-immunogen antibody or immune cells has been obtained.

In yet another alternative embodiment a viral vector, such as a retroviral vector, can be introduced into mammalian cells. Examples of mammalian cells into which the retroviral vector can be introduced include, but are not limited to, primary mammalian cultures or continuous mammalian cultures, COS cells, NIH3T3, or 293 cells (ATTC #CRL 1573), dendritic cells. The means by which the vector carrying the gene may be introduced into a cell includes, but is not limited to, microinjection, electroporation, transfection or transfection using DEAE dextran, lipofection, calcium phosphate or other procedures known to one skilled in the art (Sambrook et al. (EDS) (2001) in "Molecular Cloning. A laboratory manual", Cold Spring Harbor Press Plainview, N.Y.).

The vaccine formulation of the present invention comprises an immunogen that induces an immune response directed against the cancer associated antigens such as the CCATs, and in nonhuman primates and finally in humans. The safety of the immunization procedures is determined by looking for the effect of immunization on the general health of the immunized animal (weight change, fever, appetite behavior etc.) and looking for pathological changes on autopsies. After initial testing in animals, cancer patients can be tested. Conventional methods would be used to evaluate the immune response of the patient to determine the efficiency of the vaccine.

Measurement of candidate disease tumor antigen or vaccine expression in patients is the first step of the present invention. Subsequent steps will focus on measuring immune responses to these candidate antigens or vaccine. Sera from disease patients, particularly cancer patients, and healthy donors will be screened for antibodies to the candidate antigens as well as for levels of circulating tumor derived antigens. The vaccine formulations may be evaluated first in animal models, initially rodents In one embodiment mammals, preferably human, at high risk for colon diseases, particularly cancer, are prophylactically treated with the vaccines of this invention. Examples of such mammals include, but are not limited to, humans with a family history of colon diseases, humans with a history of colon diseases, particular cancer, or humans afflicted with colon cancer previously resected and therefore at risk for reoccurrence. When provided therapeutically, the vaccine is provided to enhance the patient's own immune response to the diseased antigen present on the colon diseases or advanced stage of colon diseases. The vaccine, which acts as an immunogen, may be a cell, cell lysate from cells transfected with a recombinant expression vector, cell lysates from cells transfected with a recombinant expression vector, or a culture supernatant containing the expressed protein. Alternatively, the immunogen is a partially or substantially purified recombinant protein, peptide or analog thereof or modified peptides or analogs thereof. The proteins or peptides may be conjugated with lipoprotein or administered in liposomal form or with adjuvant.

While it is possible for the immunogen to be administered in a pure or substantially pure form, it is preferable to present it as a pharmaceutical composition, formulation or preparation. The formulations of the present invention are described in the previous section.

Vaccination can be conducted by conventional methods. For example, the immunogen can be used in a suitable diluent such as saline or water, or complete or incomplete adjuvants. Further, the immunogen may or may not be bound to a carrier to make the protein immunogenic. Examples of such carrier molecules include but are not limited to bovine serum albumin (BSA), keyhole limpet hemocyanin (KLH), tetanus toxoid, and the like. The immunogen also may be coupled with lipoproteins or administered in liposomal form or with adjuvants. The immunogen can be administered by any route-appropriate for antibody production such as intravenous, intraperitoneal, intramuscular, subcutaneous, and the like. The immunogen may be administered once or at periodic intervals until a significant titer of anti-CCAT immune cells or anti-CCAT antibody is produced. The presence of anti-CCAT immune cells may be assessed by measuring the frequency of precursor CTL (cytoxic T-lymphocytes) against CCAT antigen prior to and after immunization by a CTL precursor analysis assay (Coulie, P. et al., (1992) International Journal Of Cancer 50:289-297). The antibody may be detected in the serum using the immunoassay described above.

The safety of the immunization procedures is determined by looking for the effect of immunization on the general health of the immunized animal (weight change, fever, appetite behavior etc.) and looking for pathological changes on autopsies. After initial testing in animals, colon disease patients can be tested. Conventional methods would be used to evaluate the immune response of the patient to determine the efficiency of the vaccine.

In yet another embodiment of this invention all, part, or parts of the CCAT proteins or peptides or fragments thereof, or modified peptides, may be exposed to dendritic cells cultured in vitro. The cultured dendritic cells provide a means of producing T-cell dependent antigens comprised of dendritic cell modified antigen or dendritic cells pulsed with antigen, in which the antigen is processed and expressed on the antigen activated dendritic cell. The CCAT antigen activated dendritic cells or processed dendritic cell antigens may be used as immunogens for vaccines or for the treatment of colon diseases, particularly colon cancer. The dendritic cells should be exposed to antigen for sufficient time to allow the antigens to be internalized and presented on the dendritic cells surface. The resulting dendritic cells or the dendritic cell process antigens can than be administered to an individual in need of therapy. Such methods are described in Steinman et al. (WO93/208185) and in Banchereau et al. (EPO Application 0563485A1).

In yet another aspect of this invention T-cells isolated from individuals can be exposed to the CCAT proteins, peptides or fragments thereof, or modified peptides in vitro and then administered to a patient in need of such treatment in a therapeutically effective amount. Examples of where T-lymphocytes can be isolated include but are not limited to, peripheral blood cells lymphocytes (PBL), lymph nodes, or tumor infiltrating lymphocytes (TIL). Such lymphocytes can be isolated from the individual to be treated or from a donor by methods known in the art and cultured in vitro (Kawakami, Y. et al. (1989) J. Immunol. 142: 2453-3461). Lymphocytes are cultured in media such as RPMI or RPMI 1640 or AIM V for 1-10 weeks. Viability is assessed by trypan blue dye exclusion assay. Examples of how these sensitized T-cells can be administered to the mammal include but are not limited to, intravenously, intraperitoneally or intralesionally. Parameters that may be assessed to determine the efficacy of these sensitized T-lymphocytes include, but are not limited to, production of immune cells in the mammal being treated or tumor regression. Conventional methods are used to assess these parameters. Such treatment can be given in conjunction with cytokines or gene modified cells (Rosenberg, S. A. et al. (1992) Human Gene Therapy, 3: 75-90; Rosenberg, S. A. et al. (1992) Human Gene Therapy, 3: 57-73).

The present invention is further described by the following example. The example is provided solely to illustrate the invention by reference to specific embodiments. This exemplification, while illustrating certain aspects of the invention, does not offer the limitations or circumscribe the scope of the disclosed invention.

All examples outlined here were carried out using standard techniques, which are well known and routine to those of skill in the art. Routine molecular biology techniques of the following example can be carried out as described in standard laboratory manuals, such as Sambrook et al., Molecular Cloning: A laboratory Manual, $3^{rd}$ Ed.; Cold Spring Harbor Laboratory, Cold Spring Harbor, N.Y. (2001).

WORKING EXAMPLES

1. Colon Tissues and Cells
Colon Cell Line

TABLE 2

| Cell line | ATCC Catalog # |
|---|---|
| SW1116 | CCL-233 |
| HT29 | HTB-38 |
| LS174T | CL-188 |
| LS 180 | CL-187 |
| SW480 | CCL-228 |
| CaCo-2 | HTB-37 |
| LS411N | CRL-2159 |
| RKO | CRL-2577 |
| Colo320DM | CCL-220 |
| HCT 15 | CCL-225 |
| HCT-116 | CCL-247 |
| LS1034 | CRL-2158 |
| LS513 | CRL-2134 |
| SNU-C2B | CCL-250 |
| SW1463 | CCL-234 |
| SW403 | CCL-230 |
| SW48 | CCL-231 |
| SW948 | CCL-237 |
| SW837 | CCL-235 |
| DLD-1 | CCL-221 |
| NCI-H548 | CCL-249 |

Colon Cancer Cell Line Culture

Cell lines were grown in a culturing medium that is supplemented as necessary with growth factors and serum (as described in Table 2). Cultures were established from frozen stocks in which the cells were suspended in a freezing medium (cell culture medium with 10% DMSO [v/v]) and flash frozen in liquid nitrogen. Frozen stocks prepared in this way were stored in the liquid nitrogen vapour. Cell cultures were established by rapidly thawing frozen stocks at 37° C. Thawed stock cultures were slowly transferred to a culture vessel containing a large volume of culture medium that was supplemented. For maintenance of culture, cells were seeded at $1\times10^5$ cells/per ml in medium and incubated at 37° C. until confluence of cells in the culture vessel exceeds 50% by area. At this time, cells were harvested from the culture vessel using enzymes or EDTA where necessary. The density of harvested, viable cells was estimated by hemocytometry and the culture reseeded as above. A passage of this nature was repeated no more than 25 times at which point the culture was destroyed and reestablished from frozen stocks as described above.

For the analyses of cell surface protein expression in cultured cell lines cells were grown as described above. At a period 24 h prior to the experiment, the cell line was passaged as described above. This yielded cell densities that were <50% confluent and growing exponentially. Typically, triplicate analyses of differential expression were performed for each line relative to control for the purpose of identifying statistically significant reproducible differentially expressed proteins.

Tissue Processing

All tissues were procured as fresh specimens. Tissues were collected as remnant tissues following surgical resection of colorectal tissues. Remnant tissues were supplied following processing for pathological diagnosis according to proper standards of patient care. Procurement of all tissues was performed in an anonymised manner in strict compliance with Federal mandated ethical and legal guidelines (HIPAA) and in accordance with clinical institution ethical review board as well as the internal institutional review board. Tissues were transported on ice in ice-cold transport buffer by courier for processing.

i) Enrichment of Epithelial Cells from Normal Colorectal Mucosa

Normal colorectal tissue was transferred from the transport vessel to a sterile dish containing 25 ml of ice-cold transport buffer. The tissue was measured, weighed and photographed. The tissue was dissected to isolate colorectal mucosa which was transferred to a fresh dish containing 25 ml ice-cold Hanks buffered saline solution. The tissue section was washed by vigorous shaking and the HBSS replaced. This was repeated 2 further times or until all visible mucus was removed. Mucosa was measured, weighed and diced into 1 mm2 sections. The tissues sections were transferred to a 50 ml polypropylene centrifuge tube containing 50 ml of A52 media (Biosource) supplemented with 2 mM L-glutamine and 1.5 mg/ml dispase (Roche Biochemicals). The digest was incubated for 1 h at 37° C. with frequent agitation. Following the incubation, the suspension was poured through a 40-mesh cell sieve situated in the base of a 15 cm culture dish. The filtrate was diluted to 50 ml using A52 media supplemented with 2 mM L-glutamine and passed through a 200-mesh cell sieve. The filtrate was collected into a 50 ml polypropylene centrifuge tube and the suspension was triturated several times followed by vortexing for 2 min at setting 6. The density and viability of nucleated cells was determined by flow cytometry using propidium iodide as a negative stain for viability (Guava system). Erythrocytes were lysed using a standard ammonium chloride lysis protocol with incubation at room temperature for 10 s. Cells were harvested by centrifugation at 500 g for 5 min at 4° C. The cell pellet was resuspended in 50 ml of ice-cold HBSS and recentrifuged. The final cell pellet was resuspended in 3 ml of ice-cold HBSS supplemented with 0.1% BSA and 0.25M EDTA. Cell density and viability were estimated using the Guava system and the density adjusted to $1\times10^7$ cells per ml. Epithelial cells were stained with a FITC-labeled anti-EpCAM murine monoclonal antibody and enriched by cell sorting using flow cytometry.

ii) Enrichment of Tumor Cells from Colorectal Tumor Tissue

Colorectal tumor tissue was transferred from the transport vessel to a sterile dish containing 25 ml of ice-cold transport buffer. The tissue was measured, weighed and photographed. The tissue was dissected to remove necrotic and fibrotic tissue plaques and the tumour tissue transferred to a fresh dish containing 25 ml ice-cold Hanks buffered saline solution. The tissue section was washed by vigorous shaking and the HBSS replaced. This was repeated 2 further times or until all visible mucus was removed. Tumour tissue was measured, weighed and extensively diced. The tissues slurry was transferred to a 50 ml polypropylene centrifuge tube containing 50 ml of A52 media (Biosource) supplemented with 2 mM L-glutamine and 1.5 mg/ml dispase (Roche Biochemicals). The digest was incubated for 1 h at 37° C. with frequent agitation. Following the incubation, the suspension was poured through a 40-mesh cell sieve situated in the base of a 15 cm culture dish. The filtrate was diluted to 50 ml using A52 media supplemented with 2 mM L-glutamine and passed through a 200-mesh cell sieve. The filtrate was collected into a 50 ml polypropylene centrifuge tube and the suspension was triturated several times followed by vortexing for 2 min at setting 6. The density and viability of nucleated cells was determined by flow cytometry using propidium iodide as a negative stain for viability (Guava system). Erythrocytes were lysed using a standard ammonium chloride lysis protocol with incubation at room temperature for 10 s. Cells were harvested by centrifugation at 500 g for 5 min at 4° C. The cell pellet was resuspended in 50 ml of ice-cold HBSS and recentrifuged. The final cell pellet was resuspended in 3 ml of ice-cold HBSS supplemented with 0.1% BSA and 0.25M EDTA. Cell density and viability were estimated using the Guava system and the density adjusted to $1 \times 10^7$ cells per ml. Epithelial cells were stained with a FITC-labeled anti-EpCAM murine monoclonal antibody and enriched by cell sorting using flow cytometry.

iii) Enrichment of Cell Surface Proteins from Sorted Epithelial and Tumor Cells

Sorted cells were centrifuged at 500 g at 4° C. for 5 min and resuspended in 50 ml of ice-cold DPBS. The cell suspension was washed by 2 further cycles of centrifugation 500 g at 4° C. for 5 min and resuspension of the cell pellet in 50 ml of ice-cold DPBS. Finally, the cell pellet was resuspended in 9.5 ml of ice-cold DPBS and sodium metaperiodate added to a final concentration of 1 mM. The cell suspension was incubated on ice for 10 min with frequent agitation in the dark. Cells were centrifuged at 500 g at 4° C. for 5 min and resuspended in 50 ml of ice-cold DPBS. The cell suspension was washed by 2 further cycles of centrifugation 500 g at 4° C. for 5 min and resuspension of the cell pellet in 50 ml of ice-cold DPBS. Finally, the cell pellet was resuspended in lysis buffer (1% SDS [w/v]; 0.1M HEPES; 10 mM $MgCl_2$; 0.1% Non ionic detergent P40; 10 µl/ml protease inhibitor cocktail [P8340, Sigma]) and homogenisation performed by passage of lysate through a 18G syringe needle 10 times. Protein concentrations were assayed relative to a Bovine serum albumin standard by a modified Lowry assay (DC assay, Bio-RAD) and 1 mg of total cellular protein transferred to a fresh tube and diluted to 1 mg/ml in acetate buffer (0.1M, pH 5.0).

2. Cloning and Expression of Target Proteins cDNA Retrieval

Peptide sequences were searched by BlastP against the CELERA DISCOVERY SYSTEM (CDS) to identify the corresponding full-length open reading frames (ORFs). Each ORF sequence was then searched by BlastN against the Celera in-house human cDNA clone collection. For each sequence of interest, up to three clones were pulled and streaked onto LB/Ampicillin (100 ug/ml) plates. Plasmid DNA was isolated using Qiagen spin mini-prep kit and verified by restriction digest. Subsequently, the isolated plasmid DNA was sequence verified against the ORF reference sequence. Sequencing reactions were carried out using Applied Biosystems BIGDYE TERMINATOR kit followed by ethanol precipitation. Sequence data was collected using the Applied Biosystems 3100 GENETIC ANALYZER and analyzed by alignment to the reference sequence using the CLONE MANAGER alignment tool.

PCR

PCR primers were designed to amplify the full-length ORF as well as any regions of the ORF that were interest for expression (antigenic or hydrophilic regions as determined by the CLONE MANAGER sequence analysis tool). Primers also contained 5' and 3' overhangs to facilitate cloning (see below). PCR reactions contained 2.5 units PLATINUM TAQ DNA POLYMERASE HIGH FIDELITY (Invitrogen), 50 ng cDNA plasmid template, 1 uM forward and reverse primers, 800 uM dNTP cocktail (Applied Biosystems) and 2 mM Mg504. After 20-30 cycles (94° C. for 30 seconds, 55° C. for 1 minutes and 73° C. for 2 minutes), product was verified and quantitated by agarose gel electrophoresis.

Construction of Entry Clones

PCR products were cloned into an entry vector for use with the Gateway recombination based cloning system (Invitrogen). These vectors included pDonr221, pDonr201, pEntr/D-TOPO or pEntr/SD/D-TOPO and were used as described in the cloning methods below.

TOPO Cloning into pEntr/D-TOPO or pEntr/SD/D-TOPO

For cloning using this method, the forward PCR primer contained a 5' overhang containing the sequence "CACC". PCR products were generated as described above and cloned into the entry vector using the Invitrogen TOPO cloning kit. Reactions were typically carried out at room temperature for 10 minutes and subsequently transformed into TOP10 chemically competent cells (Invitrogen, CA). Candidate clones were picked, plasmid DNA was prepared using Qiagen spin mini-prep kit and screened using restriction digest. Inserts were subsequently sequence verified as described above.

Gateway Cloning into pDonr201 or pDonr221

For cloning using this method, PCR primers contained the following overhangs:

Forward 5' overhang:
  5'-GGGGACAAGTTTGTACAAAAAAGCAGGCTTC-3'

Reverse 5' overhang:
  5'-GGGGACCACTTTGTACAAGAAAGCTGGGT-3'

PCR products were generated as described above. ORFs were recombined into the entry vector using the Invitrogen GATEWAY BP CLONASE enzyme mix. Reactions were typically carried out at 25° C. for 1 hour, treated with Proteinase K at 37° C. for 10 minutes and transformed into Library Efficiency DH5α chemically competent cells (Invitrogen, CA). Candidate clones were picked, plasmid DNA was prepared using Qiagen spin mini-prep kit and screened using restriction digest. Inserts were subsequently sequence verified as described above.

Construction of Expression Clones

ORFs were transferred from the entry construct into a series of expression vectors using the GATEWAY LR CLONASE enzyme mix. Reactions were typically carried out for 1 hour at 25° C., treated with Proteinase K at 37° C. for 10 minutes and subsequently transformed into Library Efficiency DH5α chemically competent cells (Invitrogen). Candidate clones were picked, plasmid DNA was prepared using Qiagen spin mini-prep kit and screened using restriction digest. Expression vectors included but were not limited to pDest14, pDest15, pDest17, pDest8, pDest10 and pDest20. These vectors allow expression in systems such as *E. coli* and recombinant baculovirus. Other vectors not listed here allow expression in yeast, mammalian cells, or in vitro.

Expression of Recombinant Proteins in *E. Coli*

Constructs were transformed into one or more of the following host strains: BL21 S1, BL21 AI, (Invitrogen); Origami B (DE3), Origami B (DE3) pLysS, Rosetta (DE3), Rosetta (DE3) pLysS, Rosetta-Gami (DE3), Rosetta-Gami (DE3) pLysS, or Rosetta-Gami B (DE3) pLysS (Novagen). The transformants were grown in LB with or without NaCl and with appropriate antibiotics, at temperatures in the range of 20-37° C., with aeration. Expression was induced with the addition of IPTG (0.03-0.3 mM) or NaCl (75-300 mM) when the cells were in mid-log growth. Growth was continued for one to 24 hours post-induction. Cells were harvested by centrifugation in a Sorvall RC-3C centrifuge in a H6000A rotor for 10 minutes at 3000 rpm, at 4° C. Cell pellets were stored at −80° C.

Expression of Recombinant Proteins Using Baculovirus

Recombinant proteins were expressed using baculovirus in Sf21 fall army worm ovarian cells. Recombinant baculoviruses were prepared using the BAC-TO-BAC SYSTEM (Invitrogen) per the manufacturer's instructions. Proteins were expressed on the large scale in Sf90011 serum-free medium (Invitrogen) in a 10 L bioreactor tank (27° C., 130 rpm, 50% dissolved oxygen for 48 hours).

3. Recombinant Protein Purification

Recombinant proteins are purified from *E. coli* and/or insect cells using a variety of standard chromatography methods. Briefly, cells are lysed using sonication or detergents. The insoluble material is pelleted by centrifugation at 10,000×g for 15 minutes. The supernatant is applied to an appropriate affinity column, e.g. His-tagged proteins are separated using a pre-packed chelating sepharose column (Pharmacia) or GST-tagged proteins are separated using a glutathione sepharose column (Pharmacia). After using the affinity column, proteins are further separated using various techniques, such as ion exchange chromatography (columns from Pharmacia) to separate on the basis of electrical charge or size exclusion chromatography (columns from Tosohaas) to separate on the basis of molecular weight, size and shape.

Expression and purification of the protein are also achieved using either a mammalian cell expression system or an insect cell expression system. The pUB6/V5-His vector system (Invitrogen, CA) is used to express GSCC in CHO cells. The vector contains the selectable bsd gene, multiple cloning sites, the promoter/enhancer sequence from the human ubiquitin C gene, a C-terminal V5 epitope for antibody detection with anti-V5 antibodies, and a C-terminal polyhistidine (6×.His) sequence for rapid purification on PROBOND resin (Invitrogen, CA). Transformed cells are selected on media containing blasticidin.

*Spodoptera frugiperda* (Sf9) insect cells are infected with recombinant *Autographica californica* nuclear polyhedrosis virus (baculovirus). The polyhedrin gene is replaced with the cDNA by homologous recombination and the polyhedrin promoter drives cDNA transcription. The protein is synthesized as a fusion protein with 6×His which enables purification as described above. Purified protein is used in the following activity and to make antibodies 4. Chemical Synthesis of Peptides Proteins or portions thereof may be produced not only by recombinant methods, but also by using chemical methods well known in the art. Solid phase peptide synthesis may be carried out in a batchwise or continuous flow process which sequentially adds α-amino- and side chain-protected amino acid residues to an insoluble polymeric support via a linker group. A linker group such as methylamine-derivatized polyethylene glycol is attached to poly(styrene-co-divinylbenzene) to form the support resin. The amino acid residues are N-a-protected by acid labile Boc (t-butyloxycarbonyl) or base-labile Fmoc (9-fluorenylmethoxycarbonyl). The carboxyl group of the protected amino acid is coupled to the amine of the linker group to anchor the residue to the solid phase support resin. Trifluoroacetic acid or piperidine are used to remove the protecting group in the case of Boc or Fmoc, respectively. Each additional amino acid is added to the anchored residue using a coupling agent or pre-activated amino acid derivative, and the resin is washed. The full length peptide is synthesized by sequential deprotection, coupling of derivitized amino acids, and washing with dichloromethane and/or N,N-dimethylformamide. The peptide is cleaved between the peptide carboxy terminus and the linker group to yield a peptide acid or amide. (Novabiochem 1997/98 Catalog and Peptide Synthesis Handbook, San Diego Calif. pp. S1-S20). Automated synthesis may also be carried out on machines such as the 431A peptide synthesizer (ABI). A protein or portion thereof may be purified by preparative high performance liquid chromatography and its composition confirmed by amino acid analysis or by sequencing (Creighton (1984) Proteins, Structures and Molecular Properties, W H Freeman, New York N.Y.).

5. Antibody Development

Polyclonal Antibody Preparations:

Polyclonal antibodies against recombinant proteins are raised in rabbits (Green Mountain Antibodies, Burlington, Vt.). Briefly, two New Zealand rabbits are immunized with 0.1 mg of antigen in complete Freund's adjuvant. Subsequent immunizations are carried out using 0.05 mg of antigen in incomplete Freund's adjuvant at days 14, 21 and 49. Bleeds are collected and screened for recognition of the antigen by solid phase ELISA and western blot analysis. The IgG fraction is separated by centrifugation at 20,000×g for 20 minutes followed by a 50% ammonium sulfate cut. The pelleted protein is resuspended in 5 mM Tris and separated by ion exchange chromatography. Fractions are pooled based on IgG content. Antigen-specific antibody is affinity purified using PIERCE AMINOLINK resin coupled to the appropriate antigen.

Isolation of Antibody Fragments Directed Against CCATs from a Library of scFvs

Naturally occurring V-genes isolated from human PBLs are constructed into a library of antibody fragments which contain reactivities against CCAT to which the donor may or may not have been exposed (see e.g., U.S. Pat. No. 5,885,793 incorporated herein by reference in its entirety).

Rescue of the Library: A library of scFvs is constructed from the RNA of human PBLs as described in PCT publication WO 92/01047. To rescue phage displaying antibody fragments, approximately $10^9$ *E. coli* harboring the phagemid are used to inoculate 50 ml of 2×TY containing 1% glucose and 100.mu.g/ml of ampicillin (2×TY-AMP-GLU) and grown to an O.D. of 0.8 with shaking. Five ml of this culture is used to innoculate 50 ml of 2×TY-AMP-GLU., $2×10^8$ TU of delta gene 3 helper (M13 delta gene III, see PCT publication WO 92/01047) are added and the culture incubated at 37° C. for 45 minutes without shaking and then at 37° C. for 45 minutes with shaking. The culture is centrifuged at 4000 r.p.m. for 10 min. and the pellet resuspended in 2 liters of 2×TY containing 100.mu.g/ml ampicillin and 50 ug/ml kanamycin and grown overnight. Phage are prepared as described in PCT publication WO 92/01047.

M13 delta gene III is prepared as follows: M13 delta gene III helper phage does not encode gene III protein, hence the phage (mid) displaying antibody fragments have a greater avidity of binding to antigen. Infectious M13 delta gene III particles are made by growing the helper phage in cells harboring a pUC19 derivative supplying the wild type gene III protein during phage morphogenesis. The culture is incubated for 1 hour at 37° C. without shaking and then for a further hour at 37° C. with shaking. Cells are spun down (IEC-Centra 8, 400 r.p.m. for 10 min), resuspended in 300 ml 2×TY broth containing 100 mug ampicillin/ml and 25 mug kanamycin/ml (2×TY-AMP-KAN) and grown overnight, shaking at 37° C. Phagre particles are purified and concentrated from the culture medium by two PEG-precipitations (Sambrook et al., 2001), resuspended in 2 ml PBS and passed through a 0.45.mu.m filter (MINISART NML; Sartorius) to give a final concentration of approximately $10^{13}$ transducing units/ml (ampicillin-resistant clones).

Panning of the Library: Immunotubes (Nunc) are coated overnight in PBS with 4 ml of either 100.mu.g/ml or 10.mu.g/ml of a polypeptide of the present invention. Tubes are blocked with 2% Marvel-PBS for 2 hours at 37° C. and then washed 3 times in PBS. Approximately 1013 TU of phage is applied to the tube and incubated for 30 minutes at room temperature tumbling on an over and under turntable and then left to stand for another 1.5 hours. Tubes are washed 10 times with PBS 0.1% Tween-20 and 10 times with PBS. Phage are eluted by adding 1 ml of 100 mM triethylamine and rotating 15 minutes on an under and over turntable after which the solution is immediately neutralized with 0.5 ml of 1.0M Tris-HCl, pH 7.4. Phages are then used to infect 10 ml of mid-log E. coli TG1 by incubating eluted phage with bacteria for 30 minutes at 37° C. The E. coli are then plated on TYE plates containing 1% glucose and 100.mu.g/ml ampicillin. The resulting bacterial library is then rescued with delta gene 3 helper phage as described above to prepare phage for a subsequent round of selection. This process is then repeated for a total of 4 rounds of affinity purification with tube-washing increased to 20 times with PBS, 0.1% Tween-20 and 20 times with PBS for rounds 3 and 4.

Characterization of Binders: Eluted phages from the 3rd and 4th rounds of selection are used to infect E. coli HB 2151 and soluble scFv is produced (Marks, et al., 1991) from single colonies for assay. ELISAs are performed with microtitre plates coated with either 10.mu.g/ml of the polypeptide of the present invention in 50 mM bicarbonate pH 9.6. Clones positive in ELISA are further characterized by PCR fingerprinting (see, e.g., PCT publication WO 92/01047) and then by sequencing.

Monoclonal Antibody Generation i) Materials:

1) Complete Media No Sera (CMNS) for washing of the myeloma and spleen cells; Hybridoma medium CM-HAT {Cell Mab (BD), 10% FBS (or HS); 5% Origen HCF (hybridoma cloning factor) containing 4 mM L-glutamine and antibiotics} to be used for plating hybridomas after the fusion.

2) Hybridoma medium CM-HT (NO AMINOPTERIN) (Cell Mab (BD), 10% FBS 5% Origen HCF containing 4 mM L-glutamine and antibiotics) to be used for fusion maintenance are stored in the refrigerator at 4-6° C. The fusions are fed on days 4, 8, and 12, and subsequent passages. Inactivated and pre-filtered commercial Fetal Bovine serum (FBS) or Horse Serum (HS) are thawed and stored in the refrigerator at 4° C. and must be pretested for myeloma growth from single cells.

3) The L-glutamine (200 mM, 100× solution), which is stored at −20° C. freezer, is thawed and warmed until completely in solution. The L-glutamine is dispensed into media to supplement growth. L-glutamine is added to 2 mM for myelomas, and 4 mM for hybridoma media. Further the Penicillin, Streptomycin, Amphotericin (antibacterial-antifungal stored at −20° C.) is thawed and added to Cell Mab Media to 1%.

4) Myeloma growth media is CELL MAB MEDIA (CELL MAB MEDIA, QUANTUM YIELD from BD is stored in the refrigerator at 4° C. in the dark) which are added L-glutamine to 2 mM and antibiotic/antimycotic solution to 1% and is called CMNS.

5) 1 bottle of PEG 1500 in Hepes (Roche, N.J.)

6) 8-Azaguanine is stored as the dried powder supplied by SIGMA at −700° C. until needed. Reconstitute 1 vial/500 ml of media and add entire contents to 500 ml media (eg. 2 vials/liter).

7) Myeloma Media is CM which has 10% FBS (or HS) and 8-Aza (1×) stored in the refrigerator at 4° C.

8) Clonal cell medium D (Stemcell, Vancouver) contains HAT and methyl cellulose for semi-solid direct cloning from the fusion.

9) Hybridoma supplements HT [hypoxanthine, thymidine] are to be used in medium for the section of hybridomas and maintenance of hybridomas through the cloning stages respectively.

10) Origen HCF can be obtained directly from Igen and is a cell supernatant produced from a macrophage-like cell-line. It can be thawed and aliquoted to 15 ml tubes at 5 ml per tube and stored frozen at −20° C. Positive Hybridomas are fed HCF through the first subcloning and are gradually weaned. It is not necessary to continue to supplement unless you have a particularly difficult hybridoma clone. This and other additives have been shown to be more effective in promoting new hybridoma growth than conventional feeder layers.

ii) Procedure

To generate monoclonal antibodies, mice are immunized with 5-50 ug of antigen either intra-peritoneally (i.p.) or by intravenous injection in the tail vein (i.v.). Typically, the antigen used is a recombinant protein that is generated as described above. The primary immunization takes place 2 months prior to the harvesting of splenocytes from the mouse and the immunization is typically boosted by i.v. injection of 5-50 ug of antigen every two weeks. At least one week prior to expected fusion date, a fresh vial of myeloma cells is thawed and cultured. Several flasks at different densities are maintained in order that a culture at the optimum density is ensured at the time of fusion. The optimum density is determined to be $3-6\times10^5$ cells/ml. Two to five days before the scheduled fusion, a final immunization is administered of ~5 ug of antigen in PBS i.p. or i.v.

Myeloma cells are washed with 30 ml serum free media by centrifugation at 500×g at 4° C. for 5 minutes. Viable cell density is determined in resuspended cells using hemocytometry and vital stains. Cells resuspended in complete growth medium are stored at 37° C. during the preparation of splenocytes. Meanwhile, to test aminopterin sensitivity, $1\times10^6$ myeloma cells are transferred to a 15 ml conical tube and centrifuged at 500 g at 4° C. for 5 minutes. The resulting pellet is resuspended in 15 ml of HAT media and cells plated at 2 drops/well on a 96 well plate.

To prepare splenocytes from immunized mice, the animals are euthanised and submerged in 70% EtOH. Under sterile conditions, the spleen is surgically removed and placed in 10 ml of RPMI medium supplemented with 20% fetal calf serum in a Petri dish. Cells are extricated from the spleen by infusing the organ with medium >50 times using a 21 g syringe.

Cells are harvested and washed by centrifugation (at 500×g at 4° C. for 5 minutes) with 30 ml of medium. Cells are resuspended in 10 ml of medium and the density of viable cells determined by hemocytometry using vital stains. The splenocytes are mixed with myeloma cells at a ratio of 5:1 (spleen cells: myeloma cells). Both the myeloma and spleen cells are washed 2 more times with 30 ml of RPMI-CMNS, and spun at 800 rpm for 12 minutes.

Supernatant is removed and cells are resuspended in 5 ml of RPMI-CMNS and are pooled to bring the volume to 30 ml and spundown as before. The cell pellet is broken up by gentle tapping and resuspended in 1 ml of BMB PEG1500 (pre-warmed to 37° C.) added dropwise with a 1 cc needle over 1 minute.

RPMI-CMNS is added to the PEG cells slowly to dilute out the PEG. Cells are centrifuged and diluted in 5 ml of Complete media and 95 ml of Clonacell Medium D (HAT) media (with 5 ml of HCF). The cells are plated out at 10 ml per small petri plate.

Myeloma/HAT control. P is prepared as follows. Dilute about 1000 P3X63 Ag8.653 myeloma cells into 1 ml of mediu D and transfer into a single well of a 24 well plate. Plates are placed in incubator, with two plates inside of a large petri plate, with an additional petri plate full of distilled water, for 10-18 days under 5% $CO_2$ overlay at 37° C. Clones are picked from semisolid agarose into 96 well plates containing 150-200 ul of CM-HT. Supernatants are screened 4 days later in ELISA, and positive clones are moved up to 24 well plates. Heavy growth will require changing of the media at day 8 (+/−150 ml). One should further decrease the HCF to 0.5% (gradually-2%, then 1%, then 0.5%) in the cloning plates. (For further references see Kohler G, and C. Milstein).

Continuous cultures of fused cells secreting antibody of predefined specificity. 1975. Nature 256: 495-497; Lane, R. D. A short duration polyethylene glycol fusion technique for increasing production of monoclonal antibody-secreting hybridomas. 1985. J. Immunol. Meth. 81:223-228;

Harlow, E. and D. Lane. Antibodies: A laboratory manual. Cold Spring Harbour Laboratory Press. 1988; Kubitz, D. The Scripps Research Institute. La Jolla. Personal Communication; Zhong, G., Berry, J. D., and Choukri, S. (1996) Mapping epitopes of *Chlamydia trachomatis* neutralizing monoclonal antibodies using phage random peptide libraries. J. Indust. Microbiol. Biotech. 19, 71-76; Berry, J. D., Licea, A., Popkov, M., Cortez, X., Fuller, R., Elia, M., Kerwin, L., and C. F. Barbas III. (2003) Rapid monoclonal antibody generation via dendritic cell targeting in vivo. Hybridoma and Hybridomics 22 (1), 23-31.

6. mRNA Expression

Validation in Tissues by TAQMAN

Expression of mRNA was quantitated by RT-PCR using TAQMAN® technology. The TAQMAN system couples a 5' fluorogenic nuclease assay with PCR for real time quantitation. A probe was used to monitor the formation of the amplification product.

Total RNA was isolated from cancer model cell lines using the RNEASY Kit® (Qiagen) per manufacturer's instructions and included DNase treatment. Normal human tissue RNAs were acquired from commercial vendors (Ambion, Austin, Tex.; Stratagene, La Jolla, Calif., BioChain Institute, Newington, N.H.) as were RNAs from matched disease/normal tissues.

Target transcript sequences were identified for the differentially expressed peptides by searching the BlastP database. TAQMAN assays (PCR primer/probe set) specific for those transcripts were identified by searching the CELERA DISCOVERY SYSTEM™ (CDS) database. The assays were designed to span exon-exon borders and do not amplify genomic DNA.

The TAQMAN primers and probe sequences were as designed by Applied Biosystems (AB) as part of the ASSAYS ON DEMAND™ product line or by custom design through the AB ASSAYS BY DESIGN$^{SM}$ service.

RT-PCR was accomplished using AMPLITAQGOLD and MULTISCRIBE reverse transcriptase in the ONE STEP RT-PCR MASTER MIX reagent kit (AB) according to the manufacturer's instructions. Probe and primer concentrations are 250 nM and 900 nM, respectively, in a 15 μl reaction. For each experiment, a master mix of the above components was made and aliquoted into each optical reaction well. Eight nanograms of total RNA was the template. Each sample was assayed in triplicate. Quantitative RT-PCR is performed using the ABI Prism® 7900HT SEQUENCE DETECTION SYSTEM (SDS). Cycling parameters follow: 48° C. for 30 min. for one cycle; 95° C. for 10 min for one cycle; 95° C. for 15 sec, 60° C. for 1 min. for 40 cycles.

The SDS software calculates the threshold cycle ($C_T$) for each reaction, and $C_T$ values were used to quantitate the relative amount of starting template in the reaction. The $C_T$ values for each set of three reactions were averaged for all subsequent calculations Data were analyzed for fold differences in expression using an endogenous control for normalization, and measuring expression relative to a normal tissue or normal cell line reference. The choice of endogenous control was determined empirically by testing various candidates against the cell line and tissue RNA panels and selecting the one with the least variation in expression. Relative changes in expression were quantitated using the $2^{-\Delta\Delta C_T}$ Method. Livak, K. J. and Schmittgen, T. D. (2001) Methods 25: 402-408; User bulletin #2: ABI Prism 7700 Sequence Detection System.

Validation by Tissue Flow Cytometry Analysis

Post tissue processing, cells were sorted by flow cytometry known in the art to enrich for epithelial cells. Alternatively, cells isolated from colon tissue were stained directly with EpCAM (for epithelial cells) and the specific antibody to CCAT. Cell numbers and viability were determined by PI exclusion (GUAVA) for cells isolated from both normal and tumor colon tissue. A minimum of $0.5 \times 10^6$ cells were used for each analysis. Cells were washed once with Flow Staining Buffer (0.5% BSA, 0.05% NaN3 in D-PBS). To the cells, 20 ul of each antibody for CCAT were added. An additional 5 ul of EpCAM antibody conjugated to APC were added when unsorted cells were used in the experiment. Cells were incubated with antibodies for 30 minutes at 4° C. Cells were washed once with Flow Staining Buffer and either analyzed immediately on the LSR flow cytometry apparatus or fixed in 1% formaldehyde and store at 4° C. until LSR analysis. The antibodies used to detect CCAT targets were all purchased by BD Biosciences and PE-conjugated. The isotype control antibody used for these experiments was PE-conjugated mouse IgGlk.

Western Analysis

Western blot analysis of target proteins are carried out using whole cell or tissue extracts prepared. To make cell extracts, the cells are resuspended in Lysis buffer (125 mM Tris, pH 7.5, 150 mM NaCl, 2% SDS, 5 mM EDTA, 0.5% NP-40) and passed through a 20-gauge needle. Lysates are centrifuged at 5,000×g for 5 minutes at 4° C. The supernatants are collected and a protease inhibitor cocktail (Sigma) is added. The PIERCE BCA assay is used to quantitate total protein. Samples are separated by SDS-PAGE and transferred to either a nitrocellulose or PVDF membrane. The WESTERN BREEZE kit from Invitrogen is used for Western blot analysis. Primary antibodies are either purchased from commercially available sources or prepared using one of the methods described in Section 5. For this application, antibodies are typically diluted 1:500 to 1:10,000 in diluent buffer. Blots were developed using PIERCE NBT.

Results

Figure 3:
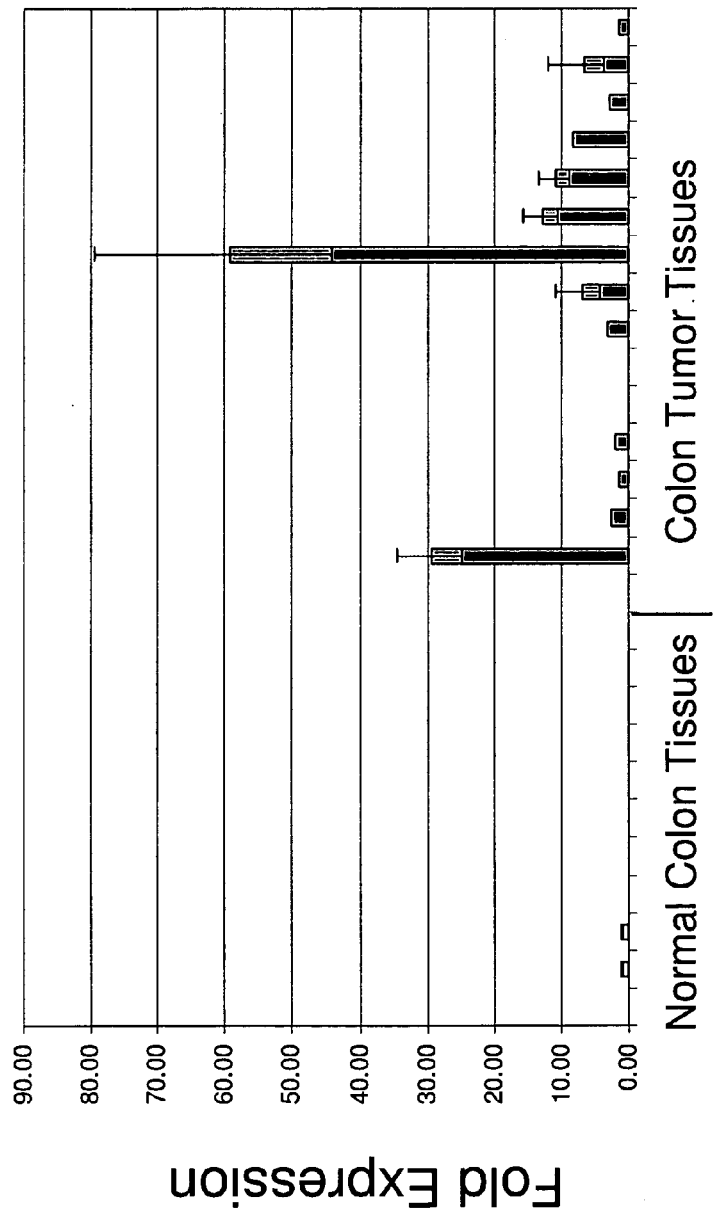
FIG. 3. Expression validation of DPEP-1 by mRNA

A range of CCAT targets were validated by TAQMAN mRNA expression. Targets such as DPEP-1 (FIG. 3) is shown to be overexpressed at mRNA level in colon tumor tissues.

Figure 4:
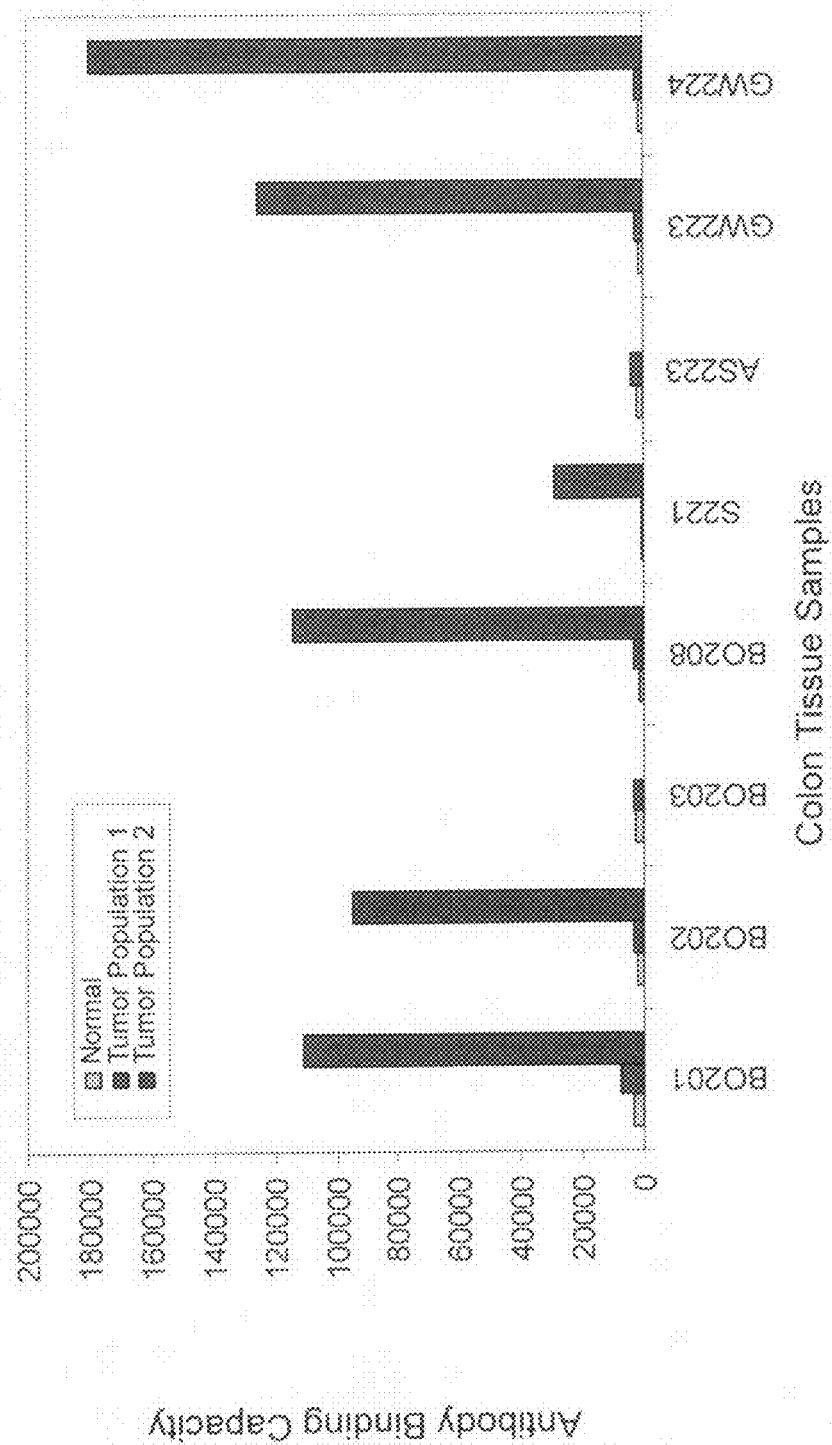
FIG. 4. Flow cytometry validation in colon tumor tissues vs. normal tissues: Prominin-1.
Figure 5:
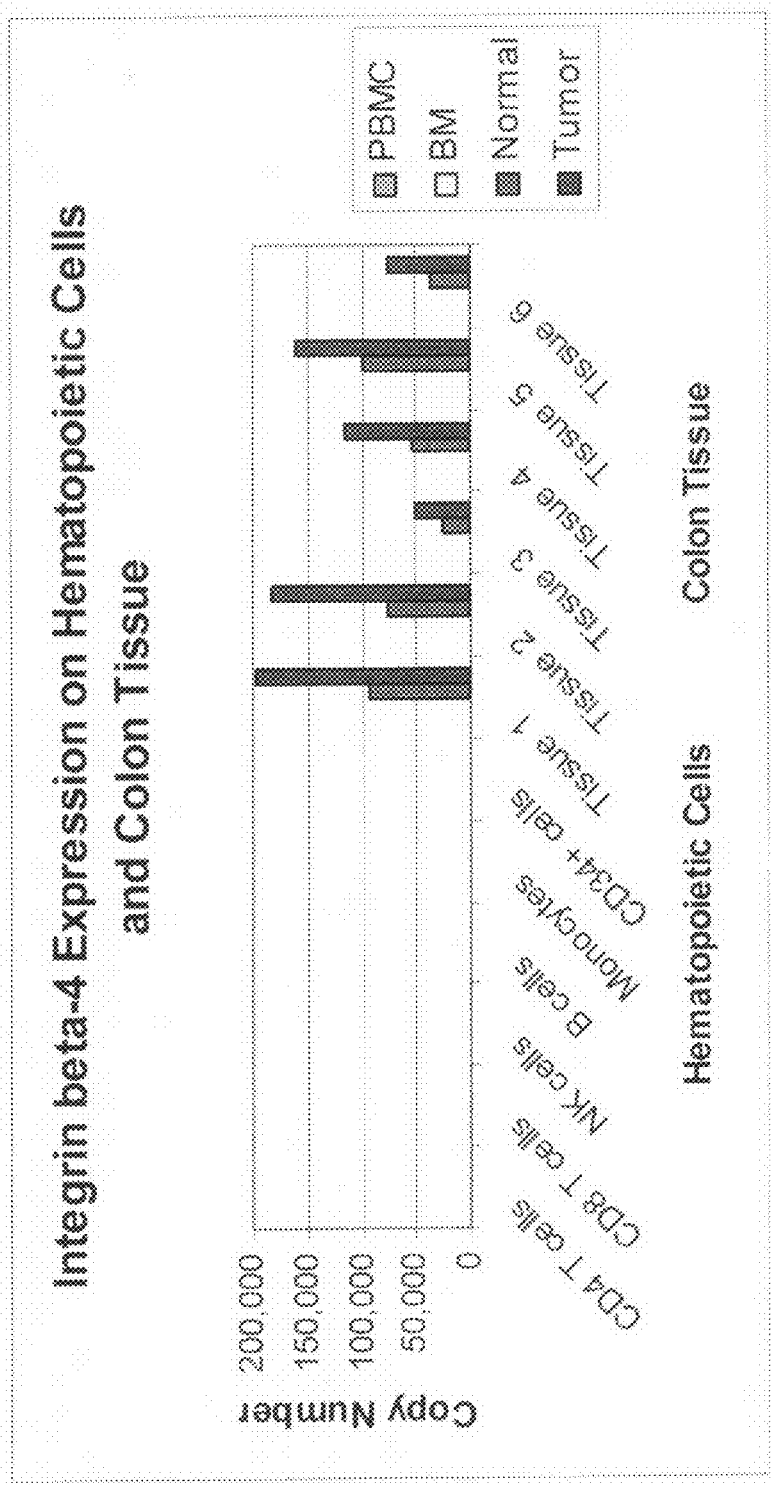
FIG. 5. Flow cytomet validation in colon tumor tissues vs. normal tissues and hematopoietic cells: Integrin Beta-4.

FACS analysis in colon tumor tissue showed that the targets include, but are not limited to Prominin-1 (FIG. 4) and Integrin beta-4 (FIG. 5) have high copy number in the colon tissue samples.

7. Detection and Diagnosis of CCAT by Liquid Chromatography and Mass Spectrometry (LC/MS)

The proteins from cells are prepared by methods known in the art (R. Aebersold Nature Biotechnology Volume 21 Number 6 Jun. 2003).

The differential expression of proteins in disease and healthy samples are quantitated using Mass Spectrometry and ICAT (Isotope Coded Affinity Tag) labeling, which is known in the art. ICAT is an isotope label technique that allows for discrimination between two populations of proteins, such as a healthy and a disease sample that are pooled together for experimental purposes or two acquisitions of the same sample for classification of true sample peptides from LC/MS noise artifacts. The LC/MS spectra are collected for the labeled samples and processed using the following steps:

The raw scans from the LC/MS instrument are subjected to peak detection and noise reduction software. Filtered peak lists are then used to detect "features" corresponding to specific peptides from the original sample(s). Features are characterized by their mass/charge, charge, retention time, isotope pattern and intensity.

Similar experiments are repeated in order to increase the confidence in detection of a peptide. These multiple acquisitions are computationally aggregated into one experiment. Experiments involving healthy and disease samples used the known effects of the ICAT label to classify the peptides as originating from a particular sample or from both samples. The intensity of a peptide present in both healthy and disease samples is used to calculate the differential expression, or relative abundance, of the peptide. The intensity of a peptide found exclusively in one sample is used to calculate a theoretical expression ratio for that peptide (singleton). Expression ratios are calculated for each peptide of each replicate of the experiment (for example, Table 1).

Statistical tests are performed to assess the robustness of the data and select statistically significant differentials. To assess general quality of the data, one: a) ensure that similar features are detected in all replicates of the experiment; b) assess the distribution of the log ratios of all peptides (a Gaussian was expected); c) calculate the overall pair wise correlations between ICAT LC/MS maps to ensure that the expression ratios for peptides are reproducible across the multiple replicates; d) aggregate multiple experiments in order to compare the expression ratio of a peptide in multiple diseases or disease samples.

8. Expression Validation by IHC in Tissue Sections

Tissue Sections

Paraffin embedded, fixed tissue sections were obtained from a panel of normal tissues (Adrenal, Bladder, Lymphocytes, Bone Marrow, Breast, Cerebellum, Cerebral cortex, Colon, Endothelium, Eye, Fallopian tube, Small Intestine, Heart, Kidney (glomerulus, tubule), Liver, Lung, Testes and Thyroid) as well as 30 tumor samples with matched normal adjacent tissues from pancreas, lung, colon, prostate, ovarian and breast. In addition, other tissues are selected for testing such as bladder renal, hepatocellular, pharyngeal and gastric tumor tissues.

Esophageal replicate sections were also obtained from numerous tumor types (Bladder Cancer, Lung Cancer, Breast Cancer, Melanoma, Colon Cancer, Non-Hodgkins Lymphoma, Endometrial Cancer, Ovarian Cancer, Head and Neck Cancer, Prostate Cancer, Leukemia [ALL and CML] and Rectal Cancer). Sections were stained with hemotoxylin and eosin and histologically examined to ensure adequate representation of cell types in each tissue section.

An identical set of tissues will be obtained from frozen sections and are used in those instances where it is not possible to generate antibodies that are suitable for fixed sections. Frozen tissues do not require an antigen retrieval step.

Paraffin Fixed Tissue Sections

Hemotoxylin and Eosin staining of paraffin embedded, fixed tissue sections.

Sections were deparaffinized in 3 changes of xylene or xylene substitute for 2-5 minutes each. Sections were rinsed in 2 changes of absolute alcohol for 1-2 minutes each, in 95% alcohol for 1 minute, followed by 80% alcohol for 1 minute. Slides were washed well in running water and stained in Gill solution 3 hemotoxylin for 3 to 5 minutes. Following a vigorous wash in running water for 1 minute, sections were stained in Scott's solution for 2 minutes. Sections were washed for 1 min in running water then conterstained in Eosin solution for 2-3 minutes depending upon development of desired staining intensity. Following a brief wash in 95% alcohol, sections were dehydrated in three changes of absolute alcohol for 1 minute each and three changes of xylene or xylene substitute for 1-2 minutes each. Slides were coverslipped and stored for analysis.

Optimisation of Antibody Staining

For each antibody, a positive and negative control sample are generated using data from the ICAT analysis of the colon cancer cell lines/tissues. Cells are selected that are known to express low levels of a particular target as determined from the ICAT data. This cell line is the reference normal control. Similarly, a colon tumor line is selected that is determined to overexpress the target is selected.

Antigen Retrieval

Sections were deparaffinized and rehydrated by washing 3 times for 5 minutes in xylene; two times for 5 minutes in 100% ethanol; two times for 5 minutes in 95% ethanol; and once for 5 minutes in 80% ethanol. Sections were then placed in endogenous blocking solution (methanol+2% hydrogen peroxide) and incubated for 20 minutes at room temperature. Sections were rinsed twice for 5 minutes each in deionized water and twice for 5 minutes in phosphate buffered saline (PBS), pH 7.4. Alternatively, where necessary sections were deparrafinized by High Energy Antigen Retrieval as follows: sections were washed three times for 5 minutes in xylene; two times for 5 minutes in 100% ethanol; two times for 5 minutes in 95% ethanol; and once for 5 minutes in 80% ethanol. Sections were placed in a Coplin jar with dilute antigen retrieval solution (10 mM citrate acid, pH 6). The Coplin jar containing slides was placed in a vessel filled with water and microwaved on high for 2-3 minutes (700 watt oven). Following cooling for 2-3 minutes, steps 3 and 4 were repeated four times (depending on tissue), followed by cooling for 20 minutes at room temperature. Sections were then rinsed in deionized water, two times for 5 minutes, placed in modified endogenous oxidation blocking solution (PBS+2% hydrogen peroxide) and rinsed for 5 minutes in PBS.

Blocking and Staining

Sections were blocked with PBS/1% bovine serum albumin (PBA) for 1 hour at room temperature followed by incubation in normal serum diluted in PBA (2%) for 30 minutes at room temperature to reduce non-specific binding of antibody. Incubations were performed in a sealed humidity chamber to prevent air-drying of the tissue sections. (The choice of blocking serum was the same as the species of the biotinylated secondary antibody). Excess antibody is gently removed by shaking and sections covered with primary antibody diluted in PBA and incubated either at room temperature for 1 hour or overnight at 4° C. (Care was taken that the sections do not touch during incubation). Sections were rinsed twice for 5 minutes in PBS, shaking gently. Excess PBS was removed by gently shaking. The sections were covered with diluted biotinylated secondary antibody in PBA and incubated for 30 minutes to 1 hour at room temperature in the humidity chamber. If using a monoclonal primary antibody, addition of 2% rat serum was used to decrease the background on rat tissue sections. Following incubation, sections were rinsed twice for 5 minutes in PBS, shaking gently. Excess PBS was removed and sections incubated for 1 hour at room temperature in VECTASTAIN ABC reagent (as per kit instructions). The lid of the humidity chamber was secured during all incunations to ensure a moist environment. Sections were rinsed twice for 5 minutes in PBS, shaking gently.

Develop and Counterstain

Sections were incubated for 2 minutes in peroxidase substrate solution that was made up immediately prior to use as follows:

10 mg diaminobenzidine (DAB) dissolved in 10 ml 50 mM sodium phosphate buffer, pH 7.4;
12.5 microliters 3% $CoCl_2/NiCl_2$ in deionized water; and
1.25 microliters hydrogen peroxide Slides were rinsed well three times for 10 min in deionized water and counterstained with 0.01% Light Green acidified with 0.01% acetic acid for 1-2 minutes depending on intensity of counterstain desired.

Slides were rinsed three times for 5 minutes with deionized water and dehydrated two times for 2 minutes in 95% ethanol; two times for 2 minutes in 100% ethanol; and two times for 2 minutes in xylene. Stained slides were mounted for visualization by microscopy.

Results:

DPEP-1 and Integrin beta 4 are shown to have high expression in tumor tissue.

9. IHC Staining of Frozen Tissue Sections

Fresh tissues are embedded carefully in OCT in plastic mold, without trapping air bubbles surrounding the tissue. Tissues are frozen by setting the mold on top of liquid nitrogen until 70-80% of the block turns white at which point the mold is placed on dry ice. The frozen blocks were stored at −80° C. Blocks are sectioned with a cryostat with care taken to avoid warming to greater than −10° C. Initially, the block is equilibrated in the cryostat for about 5 minutes and 6-10 mm sections are cut sequentially. Sections are allowed to dry for at least 30 minutes at room temperature. Following drying, tissues are stored at 4° C. for short term and −80° C. for long term storage.)

Sections are fixed by immersing in acetone jar for 1-2 minutes at room temperature, followed by drying at room temperature. Primary antibody is added (diluted in 0.05 M Tris-saline [0.05 M Tris, 0.15 M NaCl, pH 7.4], 2.5% serum) directly to the sections by covering the section dropwise to cover the tissue entirely. Binding is carried out by incubation a chamber for 1 hour at room temperature. Without letting the sections dry out, the secondary antibody (diluted in Tris-saline/2.5% serum) is added in a similar manner to the primary and incubated as before (at least 45 minutes).

Following incubation, the sections are washed gently in Tris-saline for 3-5 minutes and then in Tris-saline/2.5% serum for another 3-5 minutes. If a biotinylated primary antibody is used, in place of the secondary antibody incubation, slides are covered with 100 ul of diluted alkaline phosphatase conjugated streptavidin, incubated for 30 minutes at room temperature and washed as above. Sections are incubated with alkaline phosphatse substrate (1 mg/ml Fast Violet; 0.2 mg/ml Napthol AS-MX phosphate in Tris-Saline pH 8.5) for 10-20 minutes until the desired positive staining is achieved at which point the reaction is stopped by washing twice with Tris-saline. Slides are counter-stained with Mayer's hematoxylin for 30 seconds and washed with tap water for 2-5 minutes. Sections are mounted with Mount coverslips and mounting media.

10. Assay for Antibody Dependent Cellular Cytotoxicity

Cultured tumor cells are labeled with 100 µCi $^{51}$Cr for 1 hour (Livingston, P. O., Zhang, S., Adluri, S., Yao, T.-J., Graeber, L., Ragupathi, G., Helling, F., & Fleischer, M. (1997). Cancer Immunol. Immunother. 43, 324-330). After washing three times with culture medium, cells are resuspended at $10^5$/ml, and 100 µl/well are plated onto 96-well round-bottom plates. A range of antibody concentrations are applied to the wells, including an isotype control together with donor peripheral blood mononuclear cells that are plated at a 100:1 and 50:1 ratio. After an 18-h incubation at 37° C., supernatant (30 µl/well) is harvested and transferred onto LUMAPLATE 96 (Packard), dried, and read in a Packard TOP-COUNT NXT γ counter. Each measurement is carried out in triplicate. Spontaneous release is determined by cpm of tumor cells incubated with medium and maximum release by cpm of tumor cells plus 1% TRITON X-100 (Sigma). Specific lysis is defined as: % specific lysis=[(experimental release−spontaneous release)/(maximum release−spontaneous release)]×100. The percent ADCC is expressed as peak specific lysis postimmune subtracted by preimmune percent specific lysis. A doubling of the ADCC to >20% is considered significant.

11. Assay for Complement Dependent Cytotoxicity

Chromium release assays to assess complement-mediated cytotoxicity are performed for each patient at various time points; Dickler, M. N., Ragupathi, G., Liu, N. X., Musselli, C., Martino, D. J., Miller, V. A., Kris, M. G., Brezicka, F. T., Livingston, P. O. & Grant, S. C. (1999) Clin. Cancer Res. 5, 2773-2779. Cultured tumor cells are washed in FCS-free media two times, resuspended in 500 µl of media, and incubated with 100 µCi $^{51}$Cr per 10 million cells for 2 h at 37° C. The cells are then shaken every 15 min for 2 h, washed 3 times in media to achieve a concentration of approximately 20,000 cells/well, and then plated in round-bottom plates. The plates contain either 50 µl cells plus 50 µl monoclonal antibody, 500 cells plus serum (pre- and posttherapy), or 50 µl cells plus mouse serum as a control. The plates are incubated in a cold room on a shaker for 45 min. Human complement of a 1:5 dilution (resuspended in 1 ml of ice-cold water and diluted with 3% human serum albumin) is added to each well at a volume of 100 µl. Control wells include those for maximum release of isotope in 10% TRITON X-100 (Sigma) and for spontaneous release in the absence of complement with medium alone. The plates are incubated for 2 h at 37° C., centrifuged for 3 min, and then 100 µl of supernatant is removed for radioactivity counting. The percentage of specific lysis is calculated as follows: % cytotoxicity=[(experimental release-spontaneous release)/(maximum release-spontaneous release)]×100. A doubling of the CDC to >20% is considered significant.

12. In vitro Assays In Cell Lines

Lipofectamine was purchased from Invitrogen (Carlsbad, Calif.) and GENE SILENCER from Gene Therapy Systems (San Diego, Calif.). Synthetic siRNA oligonucleotides were from Dharmacon (Lafayette, Colo.), Qiagen (Valencia, Calif.) or Ambion (Austin, Tex.) RNEASY 96 Kit was purchased from Qiagen (Valencia, Calif.). APOP-ONE HOMOGENEOUS CASPASE-3/7 kit and CELLTITER 96 AQUEOUS ONE SOLUTION CELL PROLIFERATION ASSAY were both purchased from Promega (Madison, Wis.). Function blocking antibodies were purchased from Chemicon (Temecula, Calif.), Biotrend (Cologne, Germany) or Alexis Corporation (San Diego, Calif.). Cell invasion assay kits from purchased from Chemicon (Temecula, Calif.). RIBOGREEN RNA Quantitation Kit was purchased from Molecular probes (Eugene, Oreg.).

RNAi

RNAi was performed by using SMARTPOOLS (Dharmacon), 4-for Silencing siRNA duplexes (Qiagen) or scrambled negative control siRNA (Ambion). Transient transfections were carried out in triplicate by using either LIPOFECTAMINE 2000 from Invitrogen (Carlsbad, Calif.) or by using GENE SILENCER from Gene Therapy Systems (San Diego, Calif.) in methods described below. 1 to 4 days after transfections, total RNA was isolated by using the RNEASY 96 Kit (Qiagen) according to manufacturer's instructions and expression of mRNA was quantitated by using TAQMAN technology. Protein expression levels were examined by flow cytometry and apoptosis and proliferation assays were performed daily using APOP-ONE HOMOGENEOUS CASPASE-3/7 kit and CELLTITER 96 AQUEOUS ONE SOLUTION CELL PROLIFERATION ASSAY (see protocols below).

i) RNAi Transfections-Lipofectamine 2000

Transient transfections were carried out on sub-confluent colon cancer cell lines as previously described. Elbashir, S. M. et al. (2001) Nature 411: 494-498; Caplen, N. J. et al. (2001) Proc Natl Acad Sci USA 98: 9742-9747; Sharp, P. A. (2001) Genes and Development 15: 485-490. Synthetic RNA to gene of interest or scrambled negative control siRNA was transfected using lipofectamine according to manufacturer's instructions. Cells were plated in 96 well plates in antibiotic free medium. The next day, the transfection reagent and siRNA were prepared for transfections as follows: Each 0.1-1 ul of LIPOFECTAMINE 2000 and 10-150 mM siRNA were resuspended 25 ul serum-free media and incubated at room temperature for 5 minutes. After incubation, the diluted siRNA and the LIPOFECTAMINE 2000 were combined and incubated for 20 minutes at room temperature. The cells were then washed and the combined SIRNA-LIPOFECTAMINE 2000 reagent added. After further 4 hours incubation, 50 ul serum containing medium was added to each well. 1 and 4 days after transfection, expression of mRNA was quantitated by RT-PCR using TAQMAN technology and protein expression levels were examined by flow cytometry. Apoptosis and proliferation assays were performed daily using APOP-ONE HOMOGENEOUS CASPASE-3/7 kit and CELLTITER 96 AQUEOUS ONE SOLUTION CELL PROLIFERATION ASSAY (see protocols below).

ii) RNAi Transfections—GeneSilencer

Transient transfections were carried out on sub-confluent colon cancer cell lines as previously described. Elbashir, S. M. et al. (2001) Nature 411: 494-498; Caplen, N. J. et al. (2001) Proc Natl Acad Sci USA 98: 9742-9747; Sharp, P. A. (2001) Genes and Development 15: 485-490. Synthetic RNA to gene of interest or scrambled negative control siRNA was transfected using GENE SILENCER according to manufacturer's instructions. Cells were plated in 96 well plates in antibiotic free medium. The next day, the transfection reagent and the synthetic siRNA were prepared for transfection as follows: predetermined amount of GENE SILENCER was diluted in serum-free media to a final volume of 20 ul per well. After resuspending 10-150 mM siRNA in 20 ul serum-free media, the reagents were combined and incubated at room temperature for 5-20 minutes. After incubation, the siRNA-GENE SILENCER reagent was added to each well and incubated in a 37° C. incubator for 4 hours before an equal volume of serum containing media was added back to the cultured cells. The cells were then incubated for 1 to 4 days before mRNA, protein expression and effects on apoptosis and proliferation were examined.

Testing of Functional Blocking Antibodies

Sub-confluent colon cancer cell lines are serum-starved overnight. The next day, serum-containing media is added back to the cells in the presence of 5-50 ng/ml of function blocking antibodies. After 2 or 5 days incubation at 37° C. 5% $CO_2$, antibody binding is examined by flow cytometry and apoptosis and proliferation are examined by using protocols described below.

Apoptosis

Figure 7:
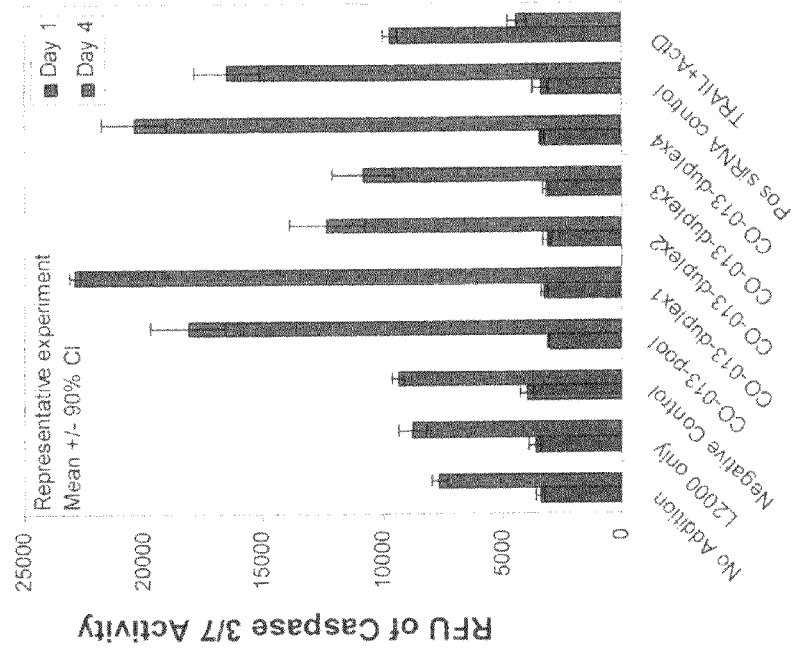
FIG. 7. Knockdown of Leukocyte Elastase induces apoptosis in HCT 116 cells.
Figure 7:
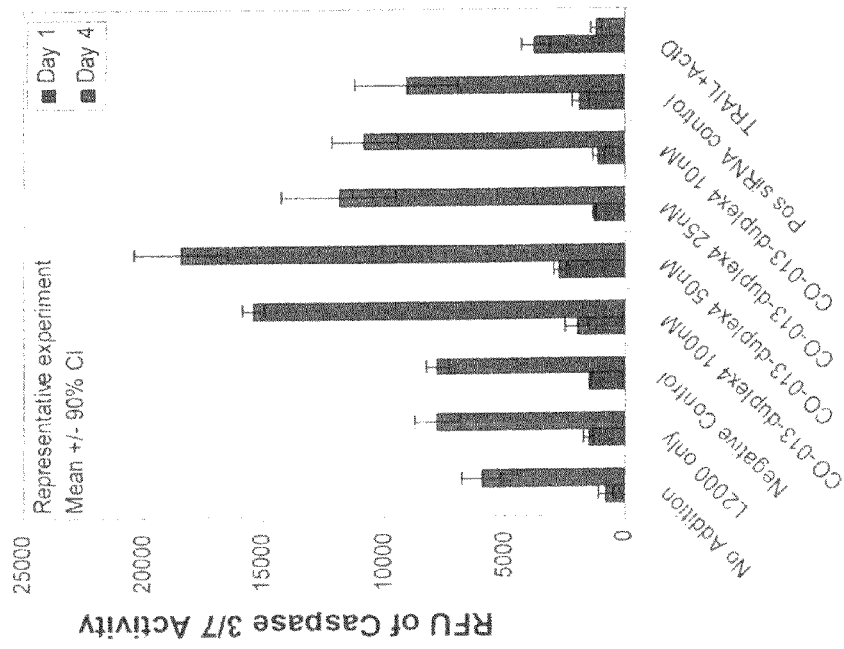
Figure 8:
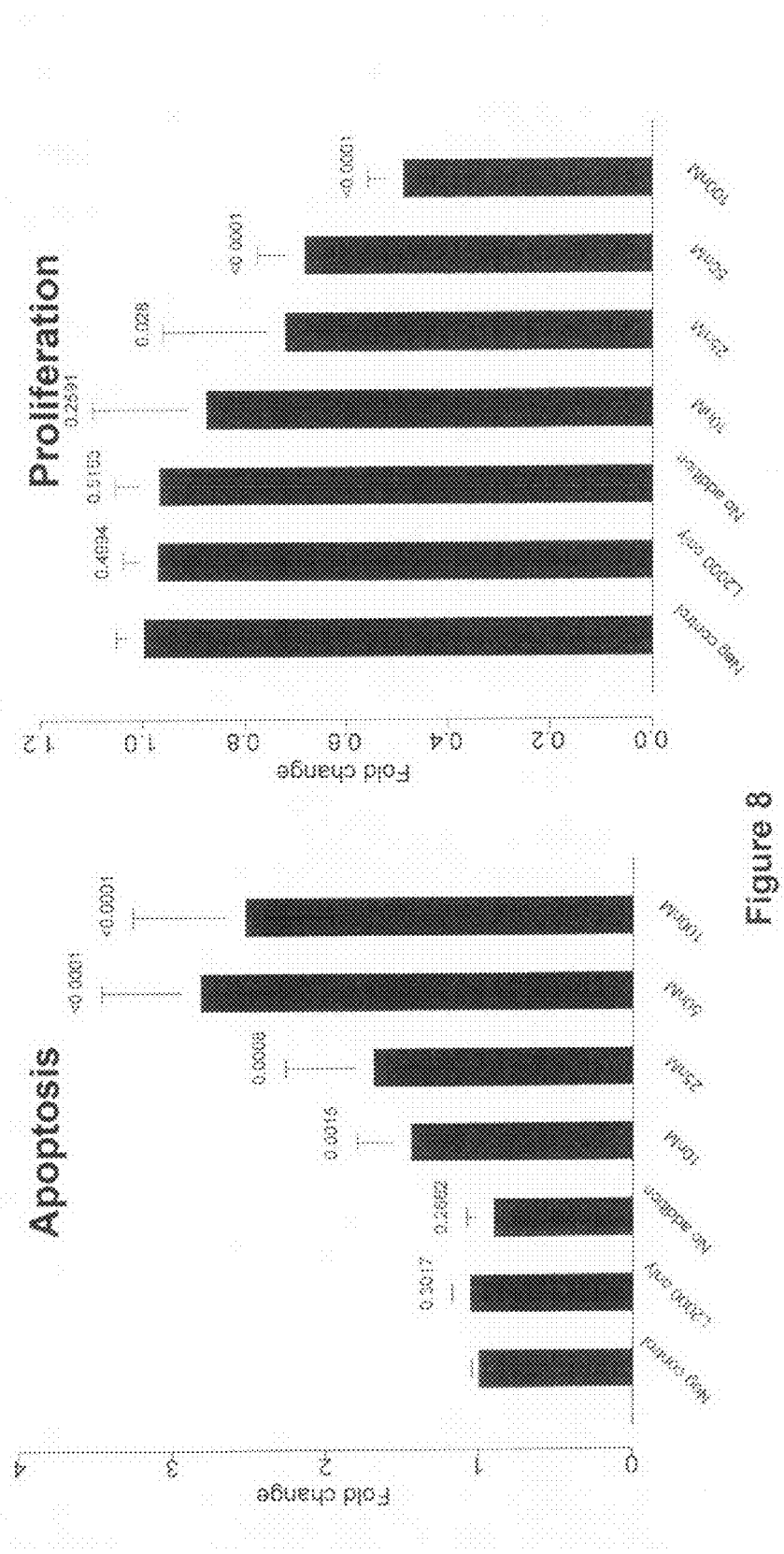
FIG. 8. Knockdown of Leukocyte Elastase induces apoptosis and inhibits proliferation in HCT 116 cells (normalized over 3 and 4 experiments) and this data was statistically significant.
Figure 9:
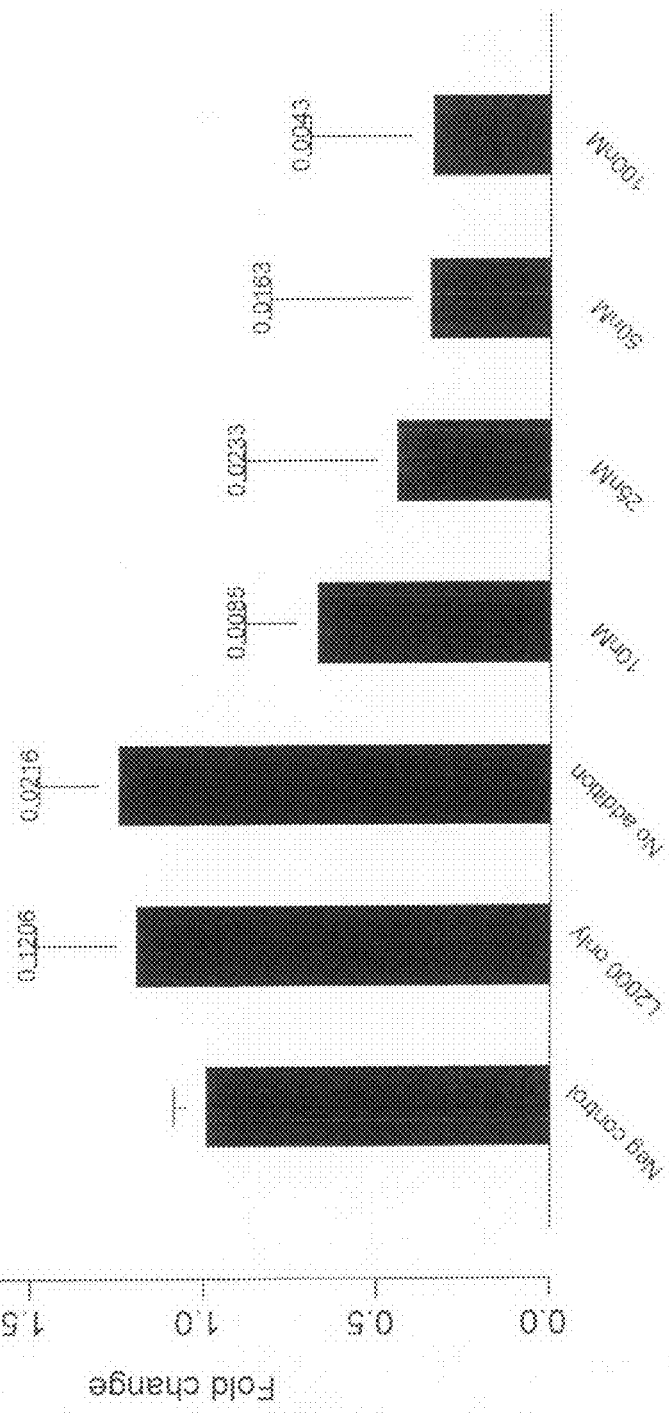
FIG. 9. Knockdown of Defensin alpha 1 inhibits proliferation and this data was statistically significant (normalized over 3 experiments).

Apoptosis assay was performed by using the APOP-ONE HOMOGENEOUS CASPASE-3/7 kit from Promega. Briefly, the caspase-3/7 substrate was thawed to room temperature and diluted 1:100 with buffer. The diluted substrate was then added 1:1 to cells, control or blank. The plates were then placed on a plate shaker for 30 minutes to 18 hours at 300-500 rpm. The fluorescence of each well was then measured at using an excitation wavelength of 485+/−20 nm and an emission wavelength of 530+/−25 nm. (FIGS. 7 and 8 and 9).

Proliferation-MTS

Proliferation assay was performed by using the CELLTITER 96 AQUEOUS ONE SOLUTION CELL PROLIFERATION ASSAY kit from Promega. 20 ul of CELLTITER 96 AQUEOUS ONE SOLUTION was added to 100 ul of culture medium. The plates were then incubated for 1-4 hours at 37° C. in a humidified 5% $CO_2$ incubator. After incubation, the change in absorbance was read at 490 nm.

Proliferation-Alamar Blue

Figure 6:
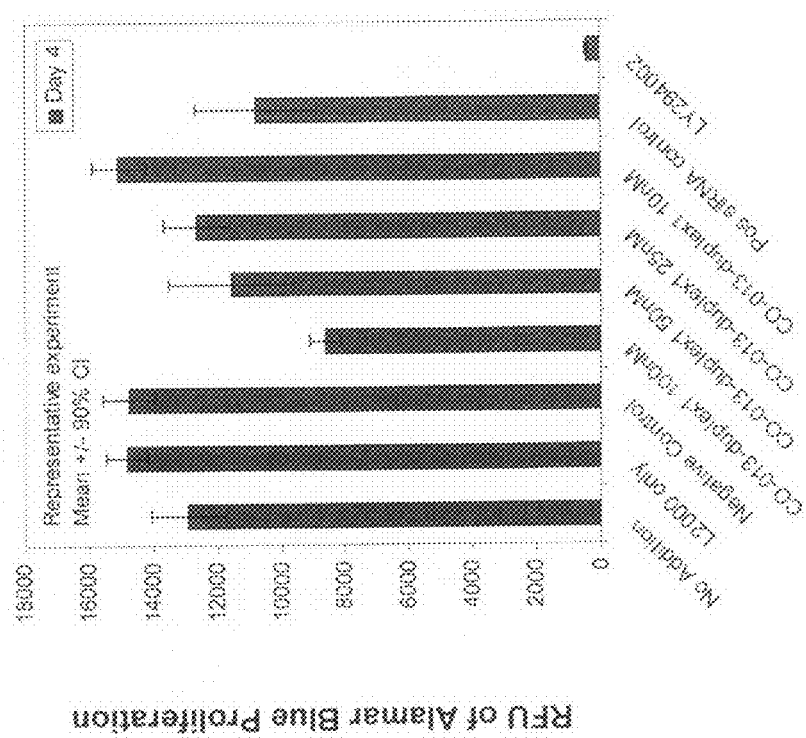
FIG. 6. Knockdown of Leukocyte Elastase mRNA inhibits proliferation in HCT-116
Figure 10:
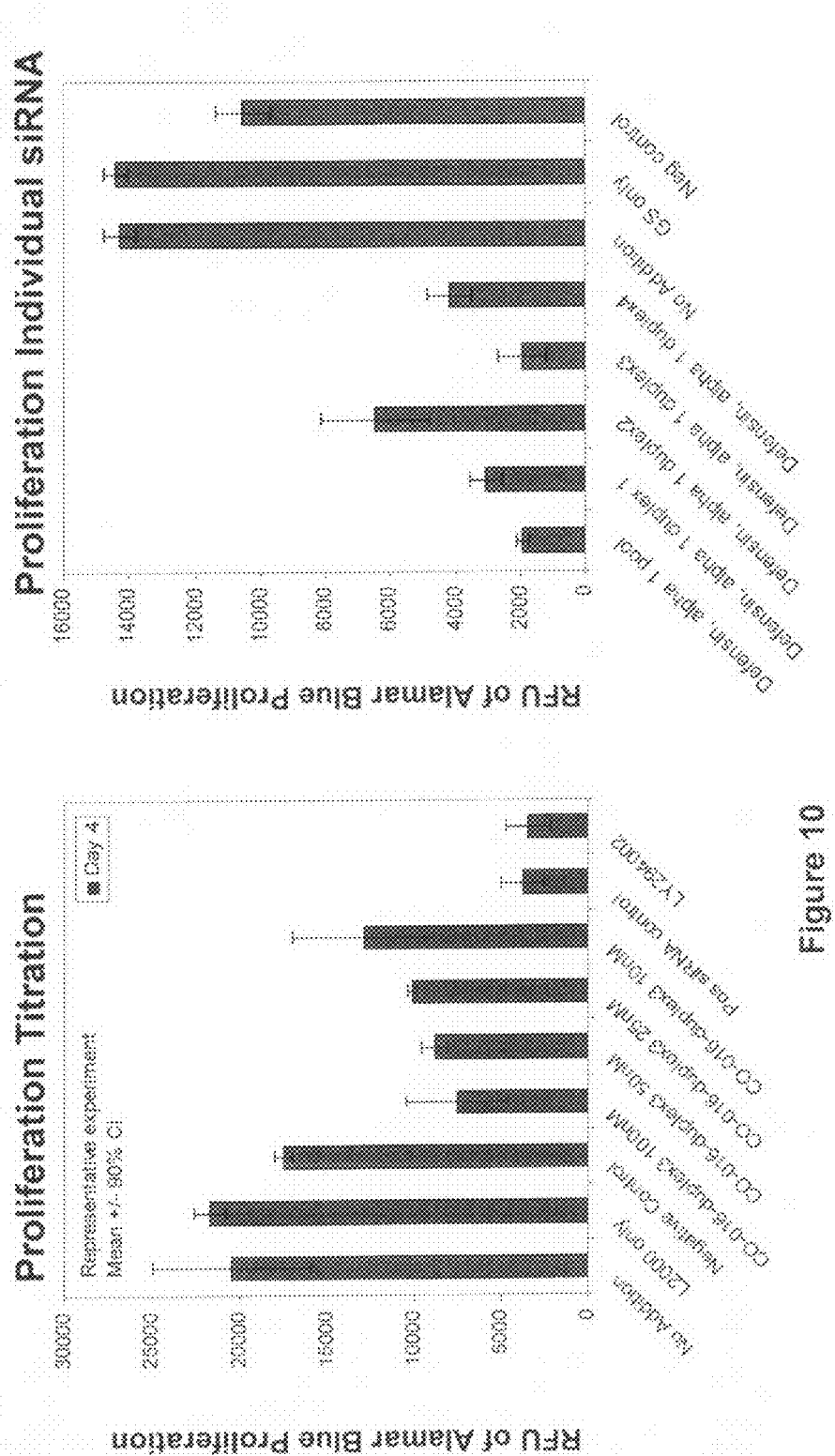
FIG. 10. Knockdown of Defensin alpha 1 mRNA inhibits proliferation in HCT 116.

Proliferation assay was performed by using the Alamar Blue assay from Biosource. 10 ul of Alamar blue reagent was added to 100 ul of cells in culture medium. The plates were then incubated for 1-4 hours at 37° C. in a humidified 5% $CO_2$ incubator. After incubation, the change in fluorescence was measured at using an excitation wavelength of 530 nm and an emission wavelength of 595 nm. Examples of the results are shown in FIG. 6, FIG. 10 with Defensin alpha 1.

Cell Invasion

Cell invasion assay is performed by using the 96 well cell invasion assay kit available from Chemicon. After the cell invasion chamber plates are adjusted to room temperature, 100 ul serum-free media is added to the interior of the inserts. 1-2 hours later, cell suspensions of $1 \times 10^6$ cells/ml are prepared. Media is then carefully removed from the inserts and 100 ul of prepared cells are added into the insert +/−0 to 50 ng function blocking antibodies. The cells are pre-incubated for 15 minutes at 37° C. before 150 ul of media containing 10% FBS is added to the lower chamber. The cells are then incubated for 48 hours at 37° C. After incubation, the cells from the top side of the insert are discarded and the invasion chamber plates are then placed on a new 96-well feeder tray containing 150 ul of pre-warmed cell detachment solution in the wells. The plates are incubated for 30 minutes at 37° C. and are periodically shaken. Lysis buffer/dye sulution (4 ul CYQUANT DYE/300 ul 4× lysis buffer) is prepared and added to each well of dissociation buffer/cells on feeder tray. The plates are incubated for 15 minutes at room temperature before 150 ul is transferred to a new 96-well plate. Fluorescence of invading cells is then read at 480 nm excitation and 520 nm emissions.

Receptor Internalization

For quantification of receptor internalization, ELISA assays are performed essentially as described by Daunt et al. (Daunt, D. A., Hurtz, C., Hein, L., Kallio, J., Feng, F., and Kobilka, B. K. (1997) Mol. Pharmacol. 51, 711-720.) The cell lines are plated at 6×10⁵ cells per in a 24-well tissue culture dishes that have previously been coated with 0.1 mg/ml poly-L-lysine. The next day, the cells are washed once with PBS and incubated in DMEM at 37° C. for several minutes. Agonist to the cell surface target of interest is then added at a pre-determined concentration in prewarmed DMEM to the wells. The cells are then incubated for various times at 37° C. and reactions are stopped by removing the media and fixing the cells in 3.7% formaldehyde/TBS for 5 min at room temperature. The cells are then washed three times with TBS and nonspecific binding blocked with TBS containing 1% BSA for 45 min at room temperature. The first antibody is added at a pre-determined dilution in TBS/BSA for 1 hr at room temperature. Three washes with TBS followed, and cells are briefly reblocked for 15 min at room temperature. Incubation with goat anti-mouse conjugated alkaline phosphatase (Bio-Rad) diluted 1:1000 in TBS/BSA is carried out for 1 h at room temperature. The cells are washed three times with TBS and a colorimetric alkaline phosphatase substrate is added. When the adequate color change is reached, 100-0 samples are taken for colorimetric readings.

mRNA Expression

RNA was obtained as the method set forth above. Expression of mRNA was quantitated by RT-PCR using TAQ-MAN® technology. Total RNA was isolated from cancer model cell lines using the RNEASY 96 kit (Qiagen) per manufacturer's instructions and included DNase treatment. Target transcript sequences were identified for the differentially expressed peptides by searching the BlastP database. TAQMAN assays (PCR primer/probe set) specific for those transcripts were identified by searching the CELERA DISCOVERY SYSTEM™ (CDS) database. The assays were designed to span exon-exon borders and do not amplify genomic DNA. The TAQMAN primers and probe sequences were as designed by Applied Biosystems (AB) as part of the ASSAYS ON DEMAND™ product line or by custom design through the AB ASSAYS BY DESIGN$^{SM}$ service. RT-PCR was accomplished using AMPLITAQGOLD and MULTI-SCRIBE reverse transcriptase in the ONE STEP RT-PCR MASTER MIX reagent kit (AB) according to the manufacturers instructions. Probe and primer concentrations are 900 nM and 250 nM, respectively, in a 250 reaction. For each experiment, a master mix of the above components was made and aliquoted into each optical reaction well. 5 ul of total RNA was the template. Each sample was assayed in triplicate. Quantitative RT-PCR was performed using the ABI Prism® 7900HT SEQUENCE DETECTION SYSTEM (SDS). Cycling parameters follow: 48° C. for 30 min. for one cycle; 95° C. for 10 min for one cycle; 95° C. for 15 sec, 60° C. for 1 min. for 40 cycles.

The SDS software calculates the threshold cycle ($C_T$) for each reaction, and $C_T$ values are used to quantitate the relative amount of starting template in the reaction. The $C_T$ values for each set of three reactions are averaged for all subsequent calculations.

Total RNA was quantitated by using RIBOGREEN RNA Quantitation Kit according to manufacturer's instructions and the % mRNA expression was calculated using total RNA for normalization. Percentage knockdown was then calculated relative to the no addition control.

Results:

Knockdown of Leukocyte Elastase, Defensin alpha 1, oligosaccharyl transferase 3, Wolframin, Ectonucleoside triphosphate diphosphohydrolase 2, T-cell surface glycoprotein CD5 induce apoptosis or inhibit cell proliferation in vitro.

13. In Vivo Studies by Using Antibodies

Treatment of Colon Cancer Cells with Monoclonal Antibodies.

Colon cancer cells are seeded at a density of 4×10⁴ cells per well in 96-well microtiter plates and allowed to adhere for 2 hours. The cells are then treated with different concentrations of anti-CCAT monoclonal antibody (Mab) or irrelevant isotype matched (anti-rHuIFN-γ Mab) at 0.05, 0.5 or 5.0 mug/ml. After a 72 hour incubation, the cell monolayers are stained with crystal violet dye for determination of relative percent viability (RPV) compared to control (untreated) cells. Each treatment group consists of replicates. Cell growth inhibition is monitored.

Treatment of NIH 3T3 Cells Overexpression CCAT Protein with Monoclonal Antibodies.

NIH 3T3 expressing CCAT protein are treated with different concentrations of anti-CCAT MAbs. Cell growth inhibition is monitored.

In vivo treatment of NIH 3T3 cells overexpressing CCAT with anti-CCAT monoclonal antibodies.

NIH 3T3 cells transfected with either a CCAT expression plasmid or the neo-DHFR vector are injected into nu/nu (athymic) mice subcutaneously at a dose of 10⁶ cells in 0.1 ml of phosphate-buffered saline. On days 0, 1, 5 and every 4 days thereafter, 100 mug (0.1 ml in PBS) of either an irrelevant or anti-CCAT monoclonal antibody of the IG2A subclass is injected intraperitoneally. Tumor occurrence and size are monitored for 1 month period of treatment.

All publications and patents mentioned in the above specification are herein incorporated by reference. Various modifications and variations of the described method and system of the invention will be apparent to those skilled in the art without departing from the scope and spirit of the invention. Although the invention has been described in connection with specific preferred embodiments, it should be understood that the invention as claimed should not be unduly limited to such specific embodiments. Indeed, various modifications of the above-described modes for carrying out the invention, which are obvious to those skilled in the field of molecular biology or related fields, are intended to be within the scope of the following claims.

Protein SEQ ID NO: 1
Celera Protein: hCP37866.2
Celera Gene: hCG20136.3
OMIM number: 165390
OMIM Information: RAS HOMOLOG GENE FAMILY, MEMBER A;ARHA
Transcript SEQ ID NO: 684
Celera Transcript: hCT11211.3

Protein SEQ ID NO: 2
Celera Protein: hCP1802868
Celera Gene: hCG20136.3
OMIM number: 165390
OMIM Information: RAS HOMOLOG GENE FAMILY, MEMBER A;ARHA -continued Transcript SEQ ID NO: 685
Celera Transcript: hCT2286519

Peptide SEQ ID NO: 1403 (104-118) Tissue AS210 , ratio = Singleton

======

Protein SEQ ID NO: 3
Celera Protein: hCP1882290
Celera Gene: hCG1997303
OMIM number: 165380
OMIM Information: RAS HOMOLOG GENE FAMILY, MEMBER C;ARHC
Transcript SEQ ID NO: 686
Celera Transcript: hCT2278786

Peptide SEQ ID NO: 1403 (190-204) Tissue AS210 , ratio = Singleton

======

Protein SEQ ID NO: 4
Public Protein Accession: P06749
Protein Name: Transforming protein RhoA (H12)
Transcript SEQ ID NO: 687
Public Transcript Accession: AF498970

Protein SEQ ID NO: 5
Celera Protein: hCP1802870
Celera Gene: hCG20136.3
OMIM number: 165390
OMIM Information: RAS HOMOLOG GENE FAMILY, MEMBER A;ARHA
Transcript SEQ ID NO: 688
Celera Transcript: hCT2286520

Protein SEQ ID NO: 6
Public Protein Accession: P08134
Protein Name: Transforming protein RhoC (H9)
Transcript SEQ ID NO: 689
Public Transcript Accession: AF498972

Peptide SEQ ID NO: 1403 (104-118) Tissue AS210 , ratio = Singleton

======

Protein SEQ ID NO: 7
Celera Protein: hCP1882287
Celera Gene: hCG1997303
OMIM number: 165380
OMIM Information: RAS HOMOLOG GENE FAMILY, MEMBER C;ARHC
Transcript SEQ ID NO: 690
Celera Transcript: hCT2278785

Peptide SEQ ID NO: 1403 (141-155) Tissue AS210 , ratio = Singleton

======

Protein SEQ ID NO: 8
Celera Protein: hCP1799463
Celera Gene: hCG1987002.2
OMIM number: 120920
OMIM Information: MEMBRANE COFACTOR PROTEIN;MCP
Transcript SEQ ID NO: 691
Celera Transcript: hCT2262680.1

Protein SEQ ID NO: 9
Public Protein Accession: NP_002380.3 P15529
Protein Name: Membrane cofactor protein precursor (CD46 antigen) (Trophoblast leucocyte common antigen) (TLX)
Transcript SEQ ID NO: 692
Public Transcript Accession: NM_002389

Protein SEQ ID NO: 10
Public Protein Accession: NP_758869.1
Protein Name: membrane cofactor protein isoform 2 precursor; CD46 antigen; complement membrane cofactor protein; measles virus receptor; trophoblast leucocyte common antigen [Homo sapiens]
Transcript SEQ ID NO: 693
Public Transcript Accession: NM_172359

Protein SEQ ID NO: 11
Public Protein Accession: NP_758862.1
Protein Name: membrane cofactor protein isoform 5 precursor; CD46 antigen; complement membrane cofactor protein; measles virus receptor; trophoblast leucocyte common antigen [Homo sapiens]

-continued

Transcript SEQ ID NO: 694
Public Transcript Accession: NM_172352

Protein SEQ ID NO: 12
Celera Protein: hCP1799459
Celera Gene: hCG1987002
OMIM number: 120920
OMIM Information: MEMBRANE COFACTOR PROTEIN;MCP
Transcript SEQ ID NO: 695
Celera Transcript: hCT2262693

Protein SEQ ID NO: 13
Public Protein Accession: P15529
Protein Name: Human MCP
Transcript SEQ ID NO: 696
Public Transcript Accession: M58050

Protein SEQ ID NO: 14
Public Protein Accession: NP_758866.1
Protein Name: membrane cofactor protein isoform 10 precursor; CD46 antigen; complement membrane cofactor protein; measles virus receptor; trophoblast leucocyte common antigen [Homo sapiens]
Transcript SEQ ID NO: 697
Public Transcript Accession: NM_172356

Protein SEQ ID NO: 15
Public Protein Accession: NP_758868.1
Protein Name: membrane cofactor protein isoform 13 precursor; CD46 antigen; complement membrane cofactor protein; measles virus receptor; trophoblast leucocyte common antigen [Homo sapiens]
Transcript SEQ ID NO: 698
Public Transcript Accession: NM_172358

Protein SEQ ID NO: 16
Celera Protein: hCP1799468
Celera Gene: hCG1987002.2
OMIM number: 120920
OMIM Information: MEMBRANE COFACTOR PROTEIN;MCP
Transcript SEQ ID NO: 699
Celera Transcript: hCT2262698.1

Protein SEQ ID NO: 17
Celera Protein: hCP1799472
Celera Gene: hCG1987002.2
OMIM number: 120920
OMIM Information: MEMBRANE COFACTOR PROTEIN;MCP
Transcript SEQ ID NO: 700
Celera Transcript: hCT2262686.1

Protein SEQ ID NO: 18
Public Protein Accession: NP_758864.1
Protein Name: membrane cofactor protein isoform 7 precursor; CD46 antigen; complement membrane cofactor protein; measles virus receptor; trophoblast leucocyte common antigen [Homo sapiens]
Transcript SEQ ID NO: 701
Public Transcript Accession: NM_172354

Protein SEQ ID NO: 19
Public Protein Accession: NP_758870.1
Protein Name: membrane cofactor protein isoform 8 precursor; CD46 antigen; complement membrane cofactor protein; measles virus receptor; trophoblast leucocyte common antigen [Homo sapiens]
Transcript SEQ ID NO: 702
Public Transcript Accession: NM_172360

Protein SEQ ID NO: 20
Public Protein Accession: NP_758865.1
Protein Name: membrane cofactor protein isoform 9 precursor; CD46 antigen; complement membrane cofactor protein; measles virus receptor; trophoblast leucocyte common antigen [Homo sapiens]
Transcript SEQ ID NO: 703
Public Transcript Accession: NM_172355

Protein SEQ ID NO: 21
Public Protein Accession: NP_758871.1
Protein Name: membrane cofactor protein isoform 12 precursor; CD46 antigen; complement membrane cofactor protein; measles virus receptor; trophoblast leucocyte common antigen [Homo sapiens]
Transcript SEQ ID NO: 704
Public Transcript Accession: NM_172361

Protein SEQ ID NO: 22
Public Protein Accession: NP_758867.1
Protein Name: membrane cofactor protein isoform 11 precursor; CD46 antigen; complement membrane cofactor protein; measles virus receptor; trophoblast leucocyte common antigen [Homo sapiens]
Transcript SEQ ID NO: 705
Public Transcript Accession: NM_172357

-continued

Peptide SEQ ID NO: 1362 (227-236) Tissue AS210 , ratio = Singleton
Peptide SEQ ID NO: 1362 (227-236) Tissue NS216 , ratio = 4.1
Peptide SEQ ID NO: 1332 (218-223) Tissue AS210 , ratio = 3.7
Peptide SEQ ID NO: 1489 (159-166) Tissue NS216 , ratio = 4.8

======

Protein SEQ ID NO: 23
Public Protein Accession: P04004
Protein Name: Vitronectin precursor (Serum spreading factor) (S-protein) (V75) [Contains: Vitronectin V65 subunit; Vitronectin V10 subunit Somatomedin B]
Transcript SEQ ID NO: 706
Public Transcript Accession: AF382388

Protein SEQ ID NO: 24
Celera Protein: hCP45342.2
Celera Gene: hCG31810.2
OMIM number: 193190
OMIM Information: VITRONECTIN;VTN
Transcript SEQ ID NO: 707
Celera Transcript: hCT22991.3

Peptide SEQ ID NO: 1417 (212-217) Tissue AS210 , ratio = >5.7
Peptide SEQ ID NO: 1464 (463-477) Tissue AS210 , ratio = Singleton

======

Protein SEQ ID NO: 25
Celera Protein: hCP1779722.1
Celera Gene: hCG201512.3
OMIM number: 600505
OMIM Information: CASEIN KINASE I, ALPHA-1;CSNK1A1
Transcript SEQ ID NO: 708
Celera Transcript: hCT1964753.1

Peptide SEQ ID NO: 1428 (17-22) Tissue NS216 , ratio = 3.3

======

Protein SEQ ID NO: 26
Public Protein Accession: P17301
Protein Name: Angiogenesis-associated human protein sequence #93

Protein SEQ ID NO: 27
Celera Protein: hCP50425.2
Celera Gene: hCG40683.3
OMIM number: 192974
OMIM Information: INTEGRIN, ALPHA-2;ITGA2
Transcript SEQ ID NO: 709
Celera Transcript: hCT31944.3

Peptide SEQ ID NO: 1428 (678-683) Tissue NS216 , ratio = 3.3

======

Protein SEQ ID NO: 28
Celera Protein: hCP201811.3
Celera Gene: hCG201512.3
OMIM number: 600505
OMIM Information: CASEIN KINASE I, ALPHA-1;CSNK1A1
Transcript SEQ ID NO: 710
Celera Transcript: hCT201515.3

Protein SEQ ID NO: 29
Celera Protein: hCP1894306
Celera Gene: hCG201512.3
OMIM number: 600505
OMIM Information: CASEIN KINASE I, ALPHA-1;CSNK1A1
Transcript SEQ ID NO: 711
Celera Transcript: hCT2260944

Protein SEQ ID NO: 30
Celera Protein: hCP1779724.1
Celera Gene: hCG201512.3
OMIM number: 600505
OMIM Information: CASEIN KINASE I, ALPHA-1;CSNK1A1
Transcript SEQ ID NO: 712
Celera Transcript: hCT1964754.1

-continued

Protein SEQ ID NO: 31
Celera Protein: hCP1779726.1
Celera Gene: hCG201512.3
OMIM number: 600505
OMIM Information: CASEIN KINASE I, ALPHA-1;CSNK1A1
Transcript SEQ ID NO: 713
Celera Transcript: hCT1964755.1

Protein SEQ ID NO: 32
Celera Protein: hCP1777673.1
Celera Gene: hCG201512.3
OMIM number: 600505
OMIM Information: CASEIN KINASE I, ALPHA-1;CSNK1A1
Transcript SEQ ID NO: 714
Celera Transcript: hCT1962993.1

Protein SEQ ID NO: 33
Celera Protein: hCP1777674.1
Celera Gene: hCG201512.3
OMIM number: 600505
OMIM Information: CASEIN KINASE I, ALPHA-1;CSNK1A1
Transcript SEQ ID NO: 715
Celera Transcript: hCT1962994.1

Protein SEQ ID NO: 34
Celera Protein: hCP1894307
Celera Gene: hCG201512.3
OMIM number: 600505
OMIM Information: CASEIN KINASE I, ALPHA-1;CSNK1A1
Transcript SEQ ID NO: 716
Celera Transcript: hCT2260947

Peptide SEQ ID NO: 1428 (17-22) Tissue NS216 , ratio = 3.3

======

Protein SEQ ID NO: 35
Celera Protein: hCP1778493.1
Celera Gene: hCG40683.3
OMIM number: 192974
OMIM Information: INTEGRIN, ALPHA-2;ITGA2
Transcript SEQ ID NO: 717
Celera Transcript: hCT1963523.1

Peptide SEQ ID NO: 1428 (678-683) Tissue NS216 , ratio = 3.3

======

Protein SEQ ID NO: 36
Celera Protein: hCP1894304
Celera Gene: hCG201512.3
OMIM number: 600505
OMIM Information: CASEIN KINASE I, ALPHA-1;CSNK1A1
Transcript SEQ ID NO: 718
Celera Transcript: hCT2260949

Protein SEQ ID NO: 37
Celera Protein: hCP1894305
Celera Gene: hCG201512.3
OMIM number: 600505
OMIM Information: CASEIN KINASE I, ALPHA-1;CSNK1A1
Transcript SEQ ID NO: 719
Celera Transcript: hCT2260950

Peptide SEQ ID NO: 1428 (17-22) Tissue NS216 , ratio = 3.3

======

Protein SEQ ID NO: 38
Celera Protein: hCP1884188
Celera Gene: hCG1980142
OMIM number: 600753
OMIM Information: GOLGI APPARATUS PROTEIN 1;GLG1
Transcript SEQ ID NO: 720
Celera Transcript: hCT2252267

Protein SEQ ID NO: 39
Public Protein Accession: Q92896
Protein Name: Golgi apparatus protein 1 precursor (Golgi sialoglycoprotein MG-160) (E-selectin ligand 1) (ESL-1) (Cysteine-rich fibroblast growth factor receptor) (CFR-1)

-continued

Transcript SEQ ID NO: 721
Public Transcript Accession: U64791

Peptide SEQ ID NO: 1341 (501-515) Tissue AS210 , ratio = Singleton

======

Protein SEQ ID NO: 40
Public Protein Accession: NP_036333.1
Protein Name: golgi apparatus protein 1; cysteine-rich fibroblast growth factor receptor [Homo sapiens]
Transcript SEQ ID NO: 722
Public Transcript Accession: NM_012201

Peptide SEQ ID NO: 1341 (500-514) Tissue AS210 , ratio = Singleton

======

Protein SEQ ID NO: 41
Celera Protein: hCP1884187
Celera Gene: hCG1980142
OMIM number: 600753
OMIM Information: GOLGI APPARATUS PROTEIN 1;GLG1
Transcript SEQ ID NO: 723
Celera Transcript: hCT2252266

Peptide SEQ ID NO: 1341 (501-515) Tissue AS210 , ratio = Singleton

======

Protein SEQ ID NO: 42
Celera Protein: hCP1787372
Celera Gene: hCG1983494
Transcript SEQ ID NO: 724
Celera Transcript: hCT2257280

Protein SEQ ID NO: 43
Public Protein Accession: P16444
Protein Name: Microsomal dipeptidase precursor (EC 3.4.13.19) (MDP) (Dehydropeptidase-I) (Renal dipeptidase) (RDP)
Transcript SEQ ID NO: 725
Public Transcript Accession: S70330

Protein SEQ ID NO: 44
Celera Protein: hCP1787371
Celera Gene: hCG1983494
Transcript SEQ ID NO: 726
Celera Transcript: hCT2257281

Peptide SEQ ID NO: 1336 (72-91) Tissue AS210 , ratio = Singleton
Peptide SEQ ID NO: 1342 (228-244) Tissue AS210 , ratio = Singleton

======

Protein SEQ ID NO: 45
Celera Protein: hCP1880536
Celera Gene: hCG38950.3
Transcript SEQ ID NO: 727
Celera Transcript: hCT2307285

Protein SEQ ID NO: 46
Celera Protein: hCP1880535
Celera Gene: hCG38950.3
Transcript SEQ ID NO: 728
Celera Transcript: hCT2307287

Protein SEQ ID NO: 47
Celera Protein: hCP49451.1
Celera Gene: hCG38950.3
Transcript SEQ ID NO: 729
Celera Transcript: hCT30196.2

Protein SEQ ID NO: 48
Public Protein Accession: NP_003339.1 Q16781
Protein Name: Ubiquitin-conjugating enzyme E2 N (EC 6.3.2.19) (Ubiquitin-protein ligase N) (Ubiquitin carrier protein N) (Ubc13) (Bendless-like ubiquitin conjugating enzyme)
Transcript SEQ ID NO: 730
Public Transcript Accession: NM_003348

Peptide SEQ ID NO: 1410 (85-91) Tissue AS210 , ratio = Singleton

======

-continued

Protein SEQ ID NO: 49
Celera Protein: hCP1903046
Celera Gene: hCG2016877
OMIM number: 601998
OMIM Information: ESTROGEN-RELATED RECEPTOR, ALPHA;ESRRA
Transcript SEQ ID NO: 731
Celera Transcript: hCT2310026

Peptide SEQ ID NO: 1401 (292-307) Tissue AS210 , ratio = Singleton

======

Protein SEQ ID NO: 50
Celera Protein: hCP1903048
Celera Gene: hCG2016877
OMIM number: 601998
OMIM Information: ESTROGEN-RELATED RECEPTOR, ALPHA;ESRRA
Transcript SEQ ID NO: 732
Celera Transcript: hCT2310025

Protein SEQ ID NO: 51
Public Protein Accession: NP_036226.1 P30044
Protein Name: Human vesicle membrane protein-like protein 1
Transcript SEQ ID NO: 733
Public Transcript Accession: NM_012094

Protein SEQ ID NO: 52
Public Protein Accession: NP_857634.1
Protein Name: peroxiredoxin 5 precursor isoform b; antioxidant enzyme B166; thioredoxin peroxidase PMP20; peroxisomal antioxidant enzyme; TPx type VI; liver tissue 2D-page spot 71B; Alu co-repressor 1 [Homo sapiens]
Transcript SEQ ID NO: 734
Public Transcript Accession: NM_181651

Protein SEQ ID NO: 53
Celera Protein: hCP1903036
Celera Gene: hCG2016877
OMIM number: 601998
OMIM Information: ESTROGEN-RELATED RECEPTOR, ALPHA;ESRRA
Transcript SEQ ID NO: 735
Celera Transcript: hCT2310023

Peptide SEQ ID NO: 1401 (86-101) Tissue AS210 , ratio = Singleton

======

Protein SEQ ID NO: 54
Celera Protein: hCP1764175
Celera Gene: hCG41341.2
OMIM number: 300017
OMIM Information: FILAMIN A;FLNA
Transcript SEQ ID NO: 736
Celera Transcript: hCT1958082.1

Peptide SEQ ID NO: 1338 (1151-1161) Tissue GW215 , ratio = Singleton
Peptide SEQ ID NO: 1487 (569-577) Tissue GW215 , ratio = Singleton
Peptide SEQ ID NO: 1348 (809-827) Tissue GW215 , ratio = Singleton
Peptide SEQ ID NO: 1363 (1452-1463) Tissue GW215 , ratio = Singleton
Peptide SEQ ID NO: 1501 (1711-1716) Tissue GW215 , ratio = Singleton
Peptide SEQ ID NO: 1447 (1399-1405) Tissue GW215 , ratio = Singleton
Peptide SEQ ID NO: 1474 (2590-2598) Tissue GW215 , ratio = Singleton
Peptide SEQ ID NO: 1411 (620-633) Tissue GW215 , ratio = Singleton
Peptide SEQ ID NO: 1421 (1007-1018) Tissue GW215 , ratio = Singleton

======

Protein SEQ ID NO: 55
Celera Protein: hCP51268.2
Celera Gene: hCG41341.2
OMIM number: 300017
OMIM Information: FILAMIN A;FLNA
Transcript SEQ ID NO: 737
Celera Transcript: hCT32611.2

Protein SEQ ID NO: 56
Public Protein Accession: P21333
Protein Name: Carboxyl terminal of filamin, amino acid sequence Peptide SEQ ID NO: 1338 (1151-1161) Tissue GW215 , ratio = Singleton
Peptide SEQ ID NO: 1487 (569-577) Tissue GW215 , ratio = Singleton -continued Peptide SEQ ID NO: 1348 (809-827) Tissue GW215 , ratio = Singleton
Peptide SEQ ID NO: 1363 (1452-1463) Tissue GW215 , ratio = Singleton
Peptide SEQ ID NO: 1501 (1719-1724) Tissue GW215 , ratio = Singleton
Peptide SEQ ID NO: 1447 (1399-1405) Tissue GW215 , ratio = Singleton
Peptide SEQ ID NO: 1474 (2598-2606) Tissue GW215 , ratio = Singleton
Peptide SEQ ID NO: 1411 (620-633) Tissue GW215 , ratio = Singleton
Peptide SEQ ID NO: 1421 (1007-1018) Tissue GW215 , ratio = Singleton

======

Protein SEQ ID NO: 57
Celera Protein: hCP1888858
Celera Gene: hCG41341.2
OMIM number: 300017
OMIM Information: FILAMIN A;FLNA
Transcript SEQ ID NO: 738
Celera Transcript: hCT2291392

Peptide SEQ ID NO: 1338 (1151-1161) Tissue GW215 , ratio = Singleton
Peptide SEQ ID NO: 1487 (569-577) Tissue GW215 , ratio = Singleton
Peptide SEQ ID NO: 1348 (809-827) Tissue GW215 , ratio = Singleton
Peptide SEQ ID NO: 1363 (1452-1463) Tissue GW215 , ratio = Singleton
Peptide SEQ ID NO: 1501 (1719-1724) Tissue GW215 , ratio = Singleton
Peptide SEQ ID NO: 1447 (1399-1405) Tissue GW215 , ratio = Singleton
Peptide SEQ ID NO: 1411 (620-633) Tissue GW215 , ratio = Singleton
Peptide SEQ ID NO: 1421 (1007-1018) Tissue GW215 , ratio = Singleton

======

Protein SEQ ID NO: 58
Celera Protein: hCP1888856
Celera Gene: hCG41341.2
OMIM number: 300017
OMIM Information: FILAMIN A;FLNA
Transcript SEQ ID NO: 739
Celera Transcript: hCT2291391

Peptide SEQ ID NO: 1338 (1151-1161) Tissue GW215 , ratio = Singleton
Peptide SEQ ID NO: 1487 (569-577) Tissue GW215 , ratio = Singleton
Peptide SEQ ID NO: 1348 (809-827) Tissue GW215 , ratio = Singleton
Peptide SEQ ID NO: 1363 (1452-1463) Tissue GW215 , ratio = Singleton
Peptide SEQ ID NO: 1447 (1399-1405) Tissue GW215 , ratio = Singleton
Peptide SEQ ID NO: 1411 (620-633) Tissue GW215 , ratio = Singleton
Peptide SEQ ID NO: 1421 (1007-1018) Tissue GW215 , ratio = Singleton

======

Protein SEQ ID NO: 59
Celera Protein: hCP1888857
Celera Gene: hCG41341.2
OMIM number: 300017
OMIM Information: FILAMIN A;FLNA
Transcript SEQ ID NO: 740
Celera Transcript: hCT2291393

Peptide SEQ ID NO: 1338 (1151-1161) Tissue GW215 , ratio = Singleton
Peptide SEQ ID NO: 1487 (569-577) Tissue GW215 , ratio = Singleton
Peptide SEQ ID NO: 1348 (809-827) Tissue GW215 , ratio = Singleton
Peptide SEQ ID NO: 1363 (1452-1463) Tissue GW215 , ratio = Singleton
Peptide SEQ ID NO: 1501 (1719-1724) Tissue GW215 , ratio = Singleton
Peptide SEQ ID NO: 1447 (1399-1405) Tissue GW215 , ratio = Singleton
Peptide SEQ ID NO: 1411 (620-633) Tissue GW215 , ratio = Singleton
Peptide SEQ ID NO: 1421 (1007-1018) Tissue GW215 , ratio = Singleton

======

Protein SEQ ID NO: 60
Public Protein Accession: P30484
Protein Name: HLA class I histocompatibility antigen, BW-46 B*4601 alpha chain precursor
Transcript SEQ ID NO: 741
Public Transcript Accession: M24033

Protein SEQ ID NO: 61
Public Protein Accession: P04222
Protein Name: HLA class I histocompatibility antigen, CW-3 CW*0301 alpha chain precursor (CW3.1)
Transcript SEQ ID NO: 742
Public Transcript Accession: X00495

Protein SEQ ID NO: 62
Celera Protein: hCP1915265

-continued

Celera Gene: hCG2043274
Transcript SEQ ID NO: 743
Celera Transcript: hCT2350013

Protein SEQ ID NO: 63
Public Protein Accession: P18465
Protein Name: HLA class I histocompatibility antigen, B-57 (B-17) B*5701 alpha chain precursor (BW57.1)
Transcript SEQ ID NO: 744
Public Transcript Accession: M32318

Protein SEQ ID NO: 64
Public Protein Accession: P18464
Protein Name: Sequence of HLA-B51 antigen
Transcript SEQ ID NO: 745
Public Transcript Accession: M32319

Protein SEQ ID NO: 65
Celera Protein: hCP1915251
Celera Gene: hCG2043274
Transcript SEQ ID NO: 746
Celera Transcript: hCT2350017

Protein SEQ ID NO: 66
Public Protein Accession: P30489
Protein Name: HLA class I histocompatibility antigen, B-51 (B-5) B*5104 alpha chain precursor
Transcript SEQ ID NO: 747
Public Transcript Accession: Z15143

Peptide SEQ ID NO: 1347 (181-192) Tissue AS210 , ratio = Singleton

======

Protein SEQ ID NO: 67
Public Protein Accession: P10321
Protein Name: HLA class I histocompatibility antigen, C-4 alpha chain
Transcript SEQ ID NO: 748
Public Transcript Accession: M11886

Peptide SEQ ID NO: 1347 (157-168) Tissue AS210 , ratio = Singleton

======

Protein SEQ ID NO: 68
Public Protein Accession: P30474
Protein Name: HLA class I histocompatibility antigen, B-35 B*3508 alpha chain precursor
Transcript SEQ ID NO: 749
Public Transcript Accession: L04696

Protein SEQ ID NO: 69
Public Protein Accession: P30495
Protein Name: HLA class I histocompatibility antigen, BW-56 (BW-22) B*5601 alpha chain precursor
Transcript SEQ ID NO: 750
Public Transcript Accession: M77776

Protein SEQ ID NO: 70
Public Protein Accession: P30468
Protein Name: HLA class I histocompatibility antigen, B-35 B*3502 alpha chain precursor
Transcript SEQ ID NO: 751
Public Transcript Accession: M63454

Protein SEQ ID NO: 71
Public Protein Accession: P30496
Protein Name: HLA class I histocompatibility antigen, BW-56 (BW-22) B*5602 alpha chain precursor
Transcript SEQ ID NO: 752
Public Transcript Accession: M77775

Protein SEQ ID NO: 72
Public Protein Accession: P30469
Protein Name: HLA class I histocompatibility antigen, B-35 B*3503 alpha chain precursor
Transcript SEQ ID NO: 753
Public Transcript Accession: M81798

Protein SEQ ID NO: 73
Public Protein Accession: P30503
Protein Name: MHC class I antigen
Transcript SEQ ID NO: 754
Public Transcript Accession: M84172

Protein SEQ ID NO: 74
Public Protein Accession: P10319

Protein Name: HLA class I histocompatibility antigen, BW-58 (B-17) B*5801 alpha chain precursor
Transcript SEQ ID NO: 755
Public Transcript Accession: AB008102

Protein SEQ ID NO: 75
Public Protein Accession: P30498
Protein Name: HLA class I histocompatibility antigen, BW-78 B*7801 alpha chain precursor
Transcript SEQ ID NO: 756
Public Transcript Accession: M33573

Protein SEQ ID NO: 76
Public Protein Accession: P30464
Protein Name: HLA class I histocompatibility antigen, BW-75 (B-15) B*1502 alpha chain precursor
Transcript SEQ ID NO: 757
Public Transcript Accession: M75138

Protein SEQ ID NO: 77
Public Protein Accession: P30472
Protein Name: HLA class I histocompatibility antigen, B-35 B*3506 alpha chain precursor (B35-K)
Transcript SEQ ID NO: 758
Public Transcript Accession: M84381

Protein SEQ ID NO: 78
Public Protein Accession: P04222
Protein Name: HLA class I heavy chain precursor
Transcript SEQ ID NO: 759
Public Transcript Accession: M99389

Protein SEQ ID NO: 79
Public Protein Accession: P30491
Protein Name: HLA class I histocompatibility antigen, BW-53 B*5301 alpha chain precursor
Transcript SEQ ID NO: 760
Public Transcript Accession: M58636

Protein SEQ ID NO: 80
Public Protein Accession: P30464
Protein Name: HLA class I histocompatibility antigen, B-62 B*15011 alpha chain precursor (MHC class I antigen)
Transcript SEQ ID NO: 761
Public Transcript Accession: U03859

Protein SEQ ID NO: 81
Public Protein Accession: P30513
Protein Name: Human leucocyte antigen B (Fragment)
Transcript SEQ ID NO: 762
Public Transcript Accession: U70528

Protein SEQ ID NO: 82
Public Protein Accession: P30685
Protein Name: HLA class I histocompatibility antigen, B-35 B*3501 alpha chain precursor Protein SEQ ID NO: 83
Public Protein Accession: P30488
Protein Name: HLA class I histocompatibility antigen, BW-50 (B-21) B*5001 alpha chain precursor Protein SEQ ID NO: 84
Public Protein Accession: P30473
Protein Name: HLA class I histocompatibility antigen, B-35 B*3507 alpha chain precursor
Transcript SEQ ID NO: 763
Public Transcript Accession: L04695

Protein SEQ ID NO: 85
Public Protein Accession: P30471
Protein Name: HLA class I histocompatibility antigen, B-35 B*3505 alpha chain precursor (B35-G)
Transcript SEQ ID NO: 764
Public Transcript Accession: M84385

Protein SEQ ID NO: 86
Public Protein Accession: P30497
Protein Name: HLA class I histocompatibility antigen, B-57 (B-17) B*5702 alpha chain precursor (BW57.2)
Transcript SEQ ID NO: 765
Public Transcript Accession: X61707

Protein SEQ ID NO: 87
Public Protein Accession: P30490
Protein Name: Sequence of HLA-Bw52 antigen Protein SEQ ID NO: 88
Public Protein Accession: P30487
Protein Name: HLA class I histocompatibility antigen, B-49 (B-21) B*4901 alpha chain precursor
Transcript SEQ ID NO: 766

Public Transcript Accession: M24037

Protein SEQ ID NO: 89
Public Protein Accession: P30465
Protein Name: HLA class I histocompatibility antigen, BW-72 (BW-70) B*1503 alpha chain precursor Peptide SEQ ID NO: 1347 (181-192) Tissue AS210 , ratio = Singleton

======

Protein SEQ ID NO: 90
Celera Protein: hCP1788525
Celera Gene: hCG2028338
Transcript SEQ ID NO: 767
Celera Transcript: hCT2328319

Protein SEQ ID NO: 91
Celera Protein: hCP1788524
Celera Gene: hCG2028338
Transcript SEQ ID NO: 768
Celera Transcript: hCT2328320

Peptide SEQ ID NO: 1476 (296-310) Tissue AS210 , ratio = 4.5

======

Protein SEQ ID NO: 92
Celera Protein: hCP1810728
Celera Gene: hCG1787714.2
Transcript SEQ ID NO: 769
Celera Transcript: hCT2333920

Peptide SEQ ID NO: 1408 (343-358) Tissue GW215 , ratio = Singleton

======

Protein SEQ ID NO: 93
Celera Protein: hCP1810731
Celera Gene: hCG1787714.2
Transcript SEQ ID NO: 770
Celera Transcript: hCT2333921

Peptide SEQ ID NO: 1408 (325-340) Tissue GW215 , ratio = Singleton

======

Protein SEQ ID NO: 94
Public Protein Accession: Q9H9G7
Protein Name: Hypothetical protein FLJ12765
Transcript SEQ ID NO: 771
Public Transcript Accession: AK022827

Peptide SEQ ID NO: 1408 (336-351) Tissue GW215 , ratio = Singleton

======

Protein SEQ ID NO: 95
Celera Protein: hCP1740205.1
Celera Gene: hCG1787714.2
Transcript SEQ ID NO: 772
Celera Transcript: hCT1826779.2

Peptide SEQ ID NO: 1408 (325-340) Tissue GW215 , ratio = Singleton

======

Protein SEQ ID NO: 96
Public Protein Accession: NP_036331.1 Q9UL18
Protein Name: Eukaryotic translation initiation factor 2C 1 (eIF2C 1) (eIF-2C 1) (Putative RNA-binding protein Q99)
Transcript SEQ ID NO: 773
Public Transcript Accession: NM_012199

Peptide SEQ ID NO: 1408 (333-348) Tissue GW215 , ratio = Singleton

======

Protein SEQ ID NO: 97
Celera Protein: hCP1633262.1
Celera Gene: hCG1640521.2
Transcript SEQ ID NO: 774

-continued

Celera Transcript: hCT1640648.3

Peptide SEQ ID NO: 1408 (336-351) Tissue GW215 , ratio = Singleton

======

Protein SEQ ID NO: 98
Celera Protein: hCP48185.2
Celera Gene: hCG38282.2
Transcript SEQ ID NO: 775
Celera Transcript: hCT29522.1

Peptide SEQ ID NO: 1408 (333-348) Tissue GW215 , ratio = Singleton

======

Protein SEQ ID NO: 99
Celera Protein: hCP1810709
Celera Gene: hCG1640521.2
Transcript SEQ ID NO: 776
Celera Transcript: hCT2333926

Peptide SEQ ID NO: 1408 (336-351) Tissue GW215 , ratio = Singleton

======

Protein SEQ ID NO: 100
Celera Protein: hCP1771040.1
Celera Gene: hCG1818102.1
OMIM number: 154100
OMIM Information: MALATE DEHYDROGENASE, MITOCHONDRIAL;MDH2
Transcript SEQ ID NO: 777
Celera Transcript: hCT1960979.1

Protein SEQ ID NO: 101
Public Protein Accession: P40926
Protein Name: Malate dehydrogenase, mitochondrial precursor (EC 1.1.1.37)
Transcript SEQ ID NO: 778
Public Transcript Accession: BC001917

Protein SEQ ID NO: 102
Public Protein Accession: NP_005909.2
Protein Name: Human mitochondrial malate dehydrogenase
Transcript SEQ ID NO: 779
Public Transcript Accession: NM_005918

Protein SEQ ID NO: 103
Celera Protein: hCP1771043
Celera Gene: hCG1818102.1
OMIM number: 154100
OMIM Information: MALATE DEHYDROGENASE, MITOCHONDRIAL;MDH2
Transcript SEQ ID NO: 780
Celera Transcript: hCT1960978.1

Peptide SEQ ID NO: 1376 (269-278) Tissue GW215 , ratio = Singleton

======

Protein SEQ ID NO: 104
Public Protein Accession: NP_149038.1
Protein Name: RECC (Transmembrane mucin MUC13)
Transcript SEQ ID NO: 781
Public Transcript Accession: NM_033049

Protein SEQ ID NO: 105
Celera Protein: hCP1738851.1
Celera Gene: hCG1780798.2
Transcript SEQ ID NO: 782
Celera Transcript: hCT1819641.2

Peptide SEQ ID NO: 1360 (366-375) Tissue AS210 , ratio = 6.9
Peptide SEQ ID NO: 1461 (347-365) Tissue AS210 , ratio = Singleton

======

Protein SEQ ID NO: 106
Celera Protein: hCP43256.2
Celera Gene: hCG27693.3
OMIM number: 604138
OMIM Information: RETINOIC ACID-INDUCED 3;RAI3

Transcript SEQ ID NO: 783
Celera Transcript: hCT18835.3

Protein SEQ ID NO: 107
Public Protein Accession: NP_003970.1
Protein Name: Putative G protein-coupled receptor (Hypothetical protein FLJ10899) (Retinoic acid induced 3)
Transcript SEQ ID NO: 784
Public Transcript Accession: NM_003979

Peptide SEQ ID NO: 1451 (272-289) Tissue AS210 , ratio = Singleton
Peptide SEQ ID NO: 1451 (272-289) Tissue GW215 , ratio = Singleton

======

Protein SEQ ID NO: 108
Celera Protein: hCP1802844
Celera Gene: hCG2002013
OMIM number: 146691
OMIM Information: IMP DEHYDROGENASE 2;IMPDH2
Transcript SEQ ID NO: 785
Celera Transcript: hCT2286550

Protein SEQ ID NO: 109
Celera Protein: hCP1802847
Celera Gene: hCG2002013
OMIM number: 146691
OMIM Information: IMP DEHYDROGENASE 2;IMPDH2
Transcript SEQ ID NO: 786
Celera Transcript: hCT2286554

Peptide SEQ ID NO: 1405 (206-218) Tissue GW215 , ratio = Singleton

======

Protein SEQ ID NO: 110
Public Protein Accession: P12268
Protein Name: Reference sequence for human IMPDH2 polypeptide
Transcript SEQ ID NO: 787
Public Transcript Accession: BC015567

Peptide SEQ ID NO: 1405 (136-148) Tissue GW215 , ratio = Singleton

======

Protein SEQ ID NO: 111
Celera Protein: hCP1802851
Celera Gene: hCG2002013
OMIM number: 146691
OMIM Information: IMP DEHYDROGENASE 2;IMPDH2
Transcript SEQ ID NO: 788
Celera Transcript: hCT2286556

Peptide SEQ ID NO: 1405 (206-218) Tissue GW215 , ratio = Singleton

======

Protein SEQ ID NO: 112
Celera Protein: hCP1802848
Celera Gene: hCG2002013
OMIM number: 146691
OMIM Information: IMP DEHYDROGENASE 2;IMPDH2
Transcript SEQ ID NO: 789
Celera Transcript: hCT2286552

Peptide SEQ ID NO: 1405 (176-188) Tissue GW215 , ratio = Singleton

======

Protein SEQ ID NO: 113
Celera Protein: hCP1802850
Celera Gene: hCG2002013
OMIM number: 146691
OMIM Information: IMP DEHYDROGENASE 2;IMPDH2
Transcript SEQ ID NO: 790
Celera Transcript: hCT2286548

Protein SEQ ID NO: 114
Celera Protein: hCP1802849
Celera Gene: hCG2002013
OMIM number: 146691

-continued

OMIM Information: IMP DEHYDROGENASE 2;IMPDH2
Transcript SEQ ID NO: 791
Celera Transcript: hCT2286559

Peptide SEQ ID NO: 1405 (206-218) Tissue GW215 , ratio = Singleton

======

Protein SEQ ID NO: 115
Celera Protein: hCP1765824.1
Celera Gene: hCG20034.3
OMIM number: 311800
OMIM Information: PHOSPHOGLYCERATE KINASE 1;PGK1
Transcript SEQ ID NO: 792
Celera Transcript: hCT1950113.1

Peptide SEQ ID NO: 1393 (365-381) Tissue GW215 , ratio = Singleton
Peptide SEQ ID NO: 1334 (106-122) Tissue AS210 , ratio = Singleton

======

Protein SEQ ID NO: 116
Public Protein Accession: XP_373387.1
Protein Name: similar to Phosphoglycerate kinase 1 (Primer recognition protein 2) (PRP 2) [Homo sapiens]

Peptide SEQ ID NO: 1393 (116-132) Tissue GW215 , ratio = Singleton

======

Protein SEQ ID NO: 117
Celera Protein: hCP37792.2
Celera Gene: hCG20034.3
OMIM number: 311800
OMIM Information: PHOSPHOGLYCERATE KINASE 1;PGK1
Transcript SEQ ID NO: 793
Celera Transcript: hCT11106.2

Protein SEQ ID NO: 118
Celera Protein: hCP1788077
Celera Gene: hCG20034.3
OMIM number: 311800
OMIM Information: PHOSPHOGLYCERATE KINASE 1;PGK1
Transcript SEQ ID NO: 794
Celera Transcript: hCT2274808

Peptide SEQ ID NO: 1393 (365-381) Tissue GW215 , ratio = Singleton
Peptide SEQ ID NO: 1334 (106-122) Tissue AS210 , ratio = Singleton

======

Protein SEQ ID NO: 119
Celera Protein: hCP1765821.1
Celera Gene: hCG20034.3
OMIM number: 311800
OMIM Information: PHOSPHOGLYCERATE KINASE 1;PGK1
Transcript SEQ ID NO: 795
Celera Transcript: hCT1950114.1

Peptide SEQ ID NO: 1393 (304-320) Tissue GW215 , ratio = Singleton
Peptide SEQ ID NO: 1334 (45-61) Tissue AS210 , ratio = Singleton

======

Protein SEQ ID NO: 120
Public Protein Accession: P00558
Protein Name: Phosphoglycerate kinase 1

Peptide SEQ ID NO: 1393 (364-380) Tissue GW215 , ratio = Singleton
Peptide SEQ ID NO: 1334 (105-121) Tissue AS210 , ratio = Singleton

======

Protein SEQ ID NO: 121
Public Protein Accession: NP_005718.2 O60635
Protein Name: Human prostate-specific amino acid sequence N1-1862/P503S
Transcript SEQ ID NO: 796
Public Transcript Accession: NM_005727

Protein SEQ ID NO: 122
Celera Protein: hCP39606.1

Celera Gene: hCG22089.3
Transcript SEQ ID NO: 797
Celera Transcript: hCT13182.3

Protein SEQ ID NO: 123
Celera Protein: hCP1810162
Celera Gene: hCG22089.3
Transcript SEQ ID NO: 798
Celera Transcript: hCT2334429

Protein SEQ ID NO: 124
Celera Protein: hCP1810167
Celera Gene: hCG22089.3
Transcript SEQ ID NO: 799
Celera Transcript: hCT2334430

Protein SEQ ID NO: 125
Celera Protein: hCP1810163
Celera Gene: hCG22089.3
Transcript SEQ ID NO: 800
Celera Transcript: hCT2334426

Protein SEQ ID NO: 126
Celera Protein: hCP1777900
Celera Gene: hCG22089.3
Transcript SEQ ID NO: 801
Celera Transcript: hCT1963360.1

Peptide SEQ ID NO: 1483 (196-208) Tissue AS210 , ratio = 3.1

======

Protein SEQ ID NO: 127
Celera Protein: hCP1637215.1
Celera Gene: hCG1641188.3
Transcript SEQ ID NO: 802
Celera Transcript: hCT1641315.2

Protein SEQ ID NO: 128
Public Protein Accession: Q9UBT2
Protein Name: ANTHRACYCLINE-associated resistance ARX (SUMO-1 activating enzyme subunit 2)
Transcript SEQ ID NO: 803
Public Transcript Accession: AF110957

Protein SEQ ID NO: 129
Celera Protein: hCP1791398
Celera Gene: hCG1641188.3
Transcript SEQ ID NO: 804
Celera Transcript: hCT2257958

Peptide SEQ ID NO: 1490 (19-33) Tissue GW215 , ratio = Singleton

======

Protein SEQ ID NO: 130
Public Protein Accession: P15170
Protein Name: G1 to S phase transition protein 1 homolog (GTP-binding protein GST1-HS)

Protein SEQ ID NO: 131
Celera Protein: hCP1893475
Celera Gene: hCG14908.2
OMIM number: 139259
OMIM Information: G1-TO-S PHASE TRANSITION 1;GSPT1
Transcript SEQ ID NO: 805
Celera Transcript: hCT2257905

Peptide SEQ ID NO: 1470 (458-475) Tissue AS210 , ratio = Singleton

======

Protein SEQ ID NO: 132
Celera Protein: hCP33922.3
Celera Gene: hCG14908.2
OMIM number: 139259
OMIM Information: G1-TO-S PHASE TRANSITION 1;GSPT1
Transcript SEQ ID NO: 806
Celera Transcript: hCT5929.2

Peptide SEQ ID NO: 1470 (596-613) Tissue AS210 , ratio = Singleton

======

Protein SEQ ID NO: 133
Public Protein Accession: NP_060564.1
Protein Name: Hypothetical protein FLJ10441
Transcript SEQ ID NO: 807
Public Transcript Accession: NM_018094

Protein SEQ ID NO: 134
Celera Protein: hCP1740556
Celera Gene: hCG1748373.2
Transcript SEQ ID NO: 808
Celera Transcript: hCT1786750.2

Peptide SEQ ID NO: 1470 (587-604) Tissue AS210 , ratio = Singleton

======

Protein SEQ ID NO: 135
Celera Protein: hCP1774432.1
Celera Gene: hCG25408.4
OMIM number: 600769
OMIM Information: TRANSMEMBRANE 4 SUPERFAMILY, MEMBER 3;TM4SF3
Transcript SEQ ID NO: 809
Celera Transcript: hCT1961391.1

Protein SEQ ID NO: 136
Celera Protein: hCP1774431.1
Celera Gene: hCG25408.4
OMIM number: 600769
OMIM Information: TRANSMEMBRANE 4 SUPERFAMILY, MEMBER 3;TM4SF3
Transcript SEQ ID NO: 810
Celera Transcript: hCT1961390.1

Protein SEQ ID NO: 137
Public Protein Accession: NP_004607.1 P19075
Protein Name: C884P predicted amino acid sequence
Transcript SEQ ID NO: 811
Public Transcript Accession: NM_004616

Protein SEQ ID NO: 138
Celera Protein: hCP42244.2
Celera Gene: hCG25408.4
OMIM number: 600769
OMIM Information: TRANSMEMBRANE 4 SUPERFAMILY, MEMBER 3;TM4SF3
Transcript SEQ ID NO: 812
Celera Transcript: hCT16533.3

Peptide SEQ ID NO: 1381 (191-203) Tissue AS210 , ratio = Singleton

======

Protein SEQ ID NO: 139
Public Protein Accession: XP_376671.1
Protein Name: coatomer protein complex, subunit gamma 2 [Homo sapiens]
Transcript SEQ ID NO: 813
Public Transcript Accession: XM_376671

Protein SEQ ID NO: 140
Public Protein Accession: NP_057212.1 Q9Y678
Protein Name: Coatomer gamma subunit (Gamma-coat protein) (Gamma-COP)
Transcript SEQ ID NO: 814
Public Transcript Accession: NM_016128

Protein SEQ ID NO: 141
Celera Protein: hCP1905162
Celera Gene: hCG2039402
OMIM number: 601029
OMIM Information: MESODERM-SPECIFIC TRANSCRIPT, MOUSE, HOMOLOG OF;MEST
Transcript SEQ ID NO: 815
Celera Transcript: hCT2306387.1

Protein SEQ ID NO: 142
Public Protein Accession: Q9UBF2
Protein Name: Coatomer gamma-2 subunit (Gamma-2 coat protein) (Gamma-2 COP)
Transcript SEQ ID NO: 816
Public Transcript Accession: AF207598

Protein SEQ ID NO: 143
Public Protein Accession: XP_371951.1

-continued

Protein Name: coatomer protein complex, subunit gamma 2 [Homo sapiens]

Protein SEQ ID NO: 144
Celera Protein: hCP1717535.2
Celera Gene: hCG1791262.2
Transcript SEQ ID NO: 817
Celera Transcript: hCT1830522.2

Peptide SEQ ID NO: 1444 (86-92) Tissue AS210 , ratio = Singleton

======

Protein SEQ ID NO: 145
Celera Protein: hCP1788230
Celera Gene: hCG18178.2
Transcript SEQ ID NO: 818
Celera Transcript: hCT2270514

Protein SEQ ID NO: 146
Celera Protein: hCP1788228
Celera Gene: hCG18178.2
Transcript SEQ ID NO: 819
Celera Transcript: hCT2270511

Protein SEQ ID NO: 147
Celera Protein: hCP1788229
Celera Gene: hCG18178.2
Transcript SEQ ID NO: 820
Celera Transcript: hCT2270513

Peptide SEQ ID NO: 1454 (267-280) Tissue AS210 , ratio = Singleton
Peptide SEQ ID NO: 1427 (266-280) Tissue AS210 , ratio = Singleton

======

Protein SEQ ID NO: 148
Celera Protein: hCP1910296
Celera Gene: hCG2023558.1
OMIM number: 190000
OMIM Information: TRANSFERRIN;TF
Transcript SEQ ID NO: 821
Celera Transcript: hCT2345011

Peptide SEQ ID NO: 1366 (146-160) Tissue AS210 , ratio = Singleton

======

Protein SEQ ID NO: 149
Celera Protein: hCP1785814
Celera Gene: hCG2023558
OMIM number: 190000
OMIM Information: TRANSFERRIN;TF
Transcript SEQ ID NO: 822
Celera Transcript: hCT2320697

Protein SEQ ID NO: 150
Public Protein Accession: P02787
Protein Name: Human serum transferrin protein
Transcript SEQ ID NO: 823
Public Transcript Accession: M12530

Peptide SEQ ID NO: 1366 (258-272) Tissue AS210 , ratio = Singleton

======

Protein SEQ ID NO: 151
Celera Protein: hCP1785815
Celera Gene: hCG2023558
OMIM number: 190000
OMIM Information: TRANSFERRIN;TF
Transcript SEQ ID NO: 824
Celera Transcript: hCT2320696

Peptide SEQ ID NO: 1366 (131-145) Tissue AS210 , ratio = Singleton

======

Protein SEQ ID NO: 152
Celera Protein: hCP1887436.1
Celera Gene: hCG2014648

-continued

OMIM number: 123840
OMIM Information: PEPTIDYLPROLYL ISOMERASE A;PPIA
Transcript SEQ ID NO: 825
Celera Transcript: hCT2306470.1

Peptide SEQ ID NO: 1407 (31-57) Tissue AS210 , ratio = Singleton

======

Protein SEQ ID NO: 153
Celera Protein: hCP1619945.3
Celera Gene: hCG1640109.4
Transcript SEQ ID NO: 826
Celera Transcript: hCT1640236.4

Peptide SEQ ID NO: 1407 (51-77) Tissue AS210 , ratio = Singleton

======

Protein SEQ ID NO: 154
Celera Protein: hCP1708003.1
Celera Gene: hCG1783178.2
Transcript SEQ ID NO: 827
Celera Transcript: hCT1822112.2

Peptide SEQ ID NO: 1407 (31-57) Tissue AS210 , ratio = Singleton

======

Protein SEQ ID NO: 155
Celera Protein: hCP1609834.2
Celera Gene: hCG1640670.2
OMIM number: 602948
OMIM Information: RAD51, S. CEREVISIAE, HOMOLOG OF, B;RAD51L1
Transcript SEQ ID NO: 828
Celera Transcript: hCT1640797.2

Peptide SEQ ID NO: 1407 (24-50) Tissue AS210 , ratio = Singleton

======

Protein SEQ ID NO: 156
Public Protein Accession: P05092
Protein Name: Haematopoietic stem cell proliferation agent related human protein #2
Transcript SEQ ID NO: 829
Public Transcript Accession: AF023861

Peptide SEQ ID NO: 1407 (90-116) Tissue AS210 , ratio = Singleton

======

Protein SEQ ID NO: 157
Celera Protein: hCP1630385.2
Celera Gene: hCG1641407.3
Transcript SEQ ID NO: 830
Celera Transcript: hCT1641534.3

Peptide SEQ ID NO: 1407 (91-117) Tissue AS210 , ratio = Singleton

======

Protein SEQ ID NO: 158
Celera Protein: hCP1864646
Celera Gene: hCG2027134
Transcript SEQ ID NO: 831
Celera Transcript: hCT2326427

Protein SEQ ID NO: 159
Celera Protein: hCP1887438.1
Celera Gene: hCG2014648
OMIM number: 123840
OMIM Information: PEPTIDYLPROLYL ISOMERASE A;PPIA
Transcript SEQ ID NO: 832
Celera Transcript: hCT2306469.1

Peptide SEQ ID NO: 1407 (31-57) Tissue AS210 , ratio = Singleton

======

Protein SEQ ID NO: 160

-continued

Public Protein Accession: XP_372328.1
Protein Name: similar to peptidylprolyl isomerase A (cyclophilin A) [Homo sapiens]
Transcript SEQ ID NO: 833
Public Transcript Accession: XM_372328

Peptide SEQ ID NO: 1407 (105-131) Tissue AS210 , ratio = Singleton

======

Protein SEQ ID NO: 161
Public Protein Accession: XP_374813.1
Protein Name: similar to peptidylprolyl isomerase A (cyclophilin A) [Homo sapiens]
Transcript SEQ ID NO: 834
Public Transcript Accession: XM_374813

Peptide SEQ ID NO: 1407 (80-106) Tissue AS210 , ratio = Singleton

======

Protein SEQ ID NO: 162
Celera Protein: hCP1617268.2
Celera Gene: hCG1641629.4
Transcript SEQ ID NO: 835
Celera Transcript: hCT1641756.4

Peptide SEQ ID NO: 1407 (25-51) Tissue AS210 , ratio = Singleton

======

Protein SEQ ID NO: 163
Celera Protein: hCP1643681.2
Public Protein Accession: XP_292963.3
Celera Gene: hCG1640137.2
Transcript SEQ ID NO: 836
Celera Transcript: hCT1640264.2
Public Transcript Accession: XM_292963

Peptide SEQ ID NO: 1407 (91-117) Tissue AS210 , ratio = Singleton

======

Protein SEQ ID NO: 164
Public Protein Accession: XP_377110.1
Protein Name: similar to peptidylprolyl isomerase A (cyclophilin A) [Homo sapiens]
Transcript SEQ ID NO: 837
Public Transcript Accession: XM_377110

Peptide SEQ ID NO: 1407 (84-110) Tissue AS210 , ratio = Singleton

======

Protein SEQ ID NO: 165
Celera Protein: hCP1630004.2
Celera Gene: hCG1640614.2
Transcript SEQ ID NO: 838
Celera Transcript: hCT1640741.2

Peptide SEQ ID NO: 1407 (91-117) Tissue AS210 , ratio = Singleton

======

Protein SEQ ID NO: 166
Celera Protein: hCP1887437.1
Celera Gene: hCG2014648
OMIM number: 123840
OMIM Information: PEPTIDYLPROLYL ISOMERASE A;PPIA
Transcript SEQ ID NO: 839
Celera Transcript: hCT2306468.1

Peptide SEQ ID NO: 1407 (31-57) Tissue AS210 , ratio = Singleton

======

Protein SEQ ID NO: 167
Celera Protein: hCP1887434
Celera Gene: hCG2014648
OMIM number: 123840
OMIM Information: PEPTIDYLPROLYL ISOMERASE A;PPIA
Transcript SEQ ID NO: 840
Celera Transcript: hCT2306471.1

Protein SEQ ID NO: 168
Celera Protein: hCP1887439.1
Celera Gene: hCG2014648
OMIM number: 123840
OMIM Information: PEPTIDYLPROLYL ISOMERASE A;PPIA
Transcript SEQ ID NO: 841
Celera Transcript: hCT2306472.1

Peptide SEQ ID NO: 1407 (158-184) Tissue AS210 , ratio = Singleton

======

Protein SEQ ID NO: 169
Celera Protein: hCP40579.2
Celera Gene: hCG23131.3
Transcript SEQ ID NO: 842
Celera Transcript: hCT14236.3

Protein SEQ ID NO: 170
Celera Protein: hCP1816336
Celera Gene: hCG23131.3
Transcript SEQ ID NO: 843
Celera Transcript: hCT2287373

Protein SEQ ID NO: 171
Public Protein Accession: O88386
Protein Name: Ras-related protein Rab-10
Transcript SEQ ID NO: 844
Public Transcript Accession: AF297660

Peptide SEQ ID NO: 1351 (123-128) Tissue AS210 , ratio = Singleton

======

Protein SEQ ID NO: 172
Celera Protein: hCP39417.2
Celera Gene: hCG20986.3
Transcript SEQ ID NO: 845
Celera Transcript: hCT12070.3

Protein SEQ ID NO: 173
Public Protein Accession: Q9Y394
Protein Name: CGI-86 protein
Transcript SEQ ID NO: 846
Public Transcript Accession: BC007337

Protein SEQ ID NO: 174
Celera Protein: hCP1868497
Celera Gene: hCG20986.3
Transcript SEQ ID NO: 847
Celera Transcript: hCT2328795

Peptide SEQ ID NO: 1365 (171-179) Tissue AS210 , ratio = 8.6

======

Protein SEQ ID NO: 175
Celera Protein: hCP34281.2
Celera Gene: hCG17225.4
OMIM number: 602970
OMIM Information: KARYOPHERIN ALPHA-4;KPNA4
Transcript SEQ ID NO: 848
Celera Transcript: hCT8274.4

Protein SEQ ID NO: 176
Celera Protein: hCP1785136
Celera Gene: hCG17225.4
OMIM number: 602970
OMIM Information: KARYOPHERIN ALPHA-4;KPNA4
Transcript SEQ ID NO: 849
Celera Transcript: hCT2318441

Protein SEQ ID NO: 177
Public Protein Accession: O00629
Protein Name: Importin alpha-4 subunit (Karyopherin alpha-4 subunit) (Qip1 protein)
Transcript SEQ ID NO: 850
Public Transcript Accession: AB002533

Peptide SEQ ID NO: 1463 (112-124) Tissue AS210 , ratio = Singleton

======

Protein SEQ ID NO: 178
Public Protein Accession: P00505
Protein Name: Aspartate aminotransferase, mitochondrial precursor (EC 2.6.1.1) (Transaminase A) (Glutamate oxaloacetate transaminase-2)
Transcript SEQ ID NO: 851
Public Transcript Accession: M22632

Protein SEQ ID NO: 179
Celera Protein: hCP1877688
Celera Gene: hCG15092.2
OMIM number: 138150
OMIM Information: GLUTAMATE OXALOACETATE TRANSAMINASE, MITOCHONDRIAL;GOT2
Transcript SEQ ID NO: 852
Celera Transcript: hCT2324016

Protein SEQ ID NO: 180
Celera Protein: hCP34784.2
Celera Gene: hCG15092.2
OMIM number: 138150
OMIM Information: GLUTAMATE OXALOACETATE TRANSAMINASE, MITOCHONDRIAL;GOT2
Transcript SEQ ID NO: 853
Celera Transcript: hCT6113.2

Peptide SEQ ID NO: 1485 (287-295) Tissue AS210 , ratio = Singleton
Peptide SEQ ID NO: 1383 (94-106) Tissue AS210 , ratio = Singleton

======

Protein SEQ ID NO: 181
Celera Protein: hCP1815424
Celera Gene: hCG1986857
OMIM number: 602559
OMIM Information: EXPORTIN 1;XPO1
Transcript SEQ ID NO: 854
Celera Transcript: hCT2262470

Protein SEQ ID NO: 182
Celera Protein: hCP1815425
Celera Gene: hCG1986857
OMIM number: 602559
OMIM Information: EXPORTIN 1;XPO1
Transcript SEQ ID NO: 855
Celera Transcript: hCT2262469

Protein SEQ ID NO: 183
Celera Protein: hCP1815427
Celera Gene: hCG1986857
OMIM number: 602559
OMIM Information: EXPORTIN 1;XPO1
Transcript SEQ ID NO: 856
Celera Transcript: hCT2262471

Peptide SEQ ID NO: 1449 (492-514) Tissue AS210 , ratio = Singleton

======

Protein SEQ ID NO: 184
Celera Protein: hCP1884614
Celera Gene: hCG1981144
Transcript SEQ ID NO: 857
Celera Transcript: hCT2253865

Peptide SEQ ID NO: 1415 (107-123) Tissue AS210 , ratio = Singleton

======

Protein SEQ ID NO: 185
Celera Protein: hCP1854784
Celera Gene: hCG1993805
OMIM number: 138130
OMIM Information: GLUTAMATE DEHYDROGENASE 1;GLUD1
Transcript SEQ ID NO: 858
Celera Transcript: hCT2273052

Peptide SEQ ID NO: 1415 (27-43) Tissue AS210 , ratio = Singleton

======

-continued

Protein SEQ ID NO: 186
Celera Protein: hCP1854785
Celera Gene: hCG1993805
OMIM number: 138130
OMIM Information: GLUTAMATE DEHYDROGENASE 1;GLUD1
Transcript SEQ ID NO: 859
Celera Transcript: hCT2273053

Peptide SEQ ID NO: 1415 (24-40) Tissue AS210 , ratio = Singleton

======

Protein SEQ ID NO: 187
Public Protein Accession: XP_208418.1 P49448
Protein Name: Glutamate dehydrogenase 2, mitochondrial precursor (EC 1.4.1.3) (GDH)

Protein SEQ ID NO: 188
Celera Protein: hCP1854783
Celera Gene: hCG1993805
OMIM number: 138130
OMIM Information: GLUTAMATE DEHYDROGENASE 1;GLUD1
Transcript SEQ ID NO: 860
Celera Transcript: hCT2273057

Protein SEQ ID NO: 189
Public Protein Accession: P00367
Protein Name: Glutamate dehydrogenase 1, mitochondrial precursor (EC 1.4.1.3) (GDH)
Transcript SEQ ID NO: 861
Public Transcript Accession: BC040132

Peptide SEQ ID NO: 1415 (107-123) Tissue AS210 , ratio = Singleton

======

Protein SEQ ID NO: 190
Celera Protein: hCP1884615
Celera Gene: hCG1981144
Transcript SEQ ID NO: 862
Celera Transcript: hCT2253864

Peptide SEQ ID NO: 1415 (41-57) Tissue AS210 , ratio = Singleton

======

Protein SEQ ID NO: 191
Celera Protein: hCP1854786
Celera Gene: hCG1993805
OMIM number: 138130
OMIM Information: GLUTAMATE DEHYDROGENASE 1;GLUD1
Transcript SEQ ID NO: 863
Celera Transcript: hCT2273055

Peptide SEQ ID NO: 1415 (107-123) Tissue AS210 , ratio = Singleton

======

Protein SEQ ID NO: 192
Celera Protein: hCP45303.3
Celera Gene: hCG31775.3
Transcript SEQ ID NO: 864
Celera Transcript: hCT22956.3

Peptide SEQ ID NO: 1386 (134-142) Tissue AS210 , ratio = Singleton

======

Protein SEQ ID NO: 193
Public Protein Accession: O94973
Protein Name: Human polypeptide SEQ ID NO 2276
Transcript SEQ ID NO: 865
Public Transcript Accession: BC006155

Peptide SEQ ID NO: 1386 (528-536) Tissue AS210 , ratio = Singleton

======

Protein SEQ ID NO: 194
Celera Protein: hCP1860966
Celera Gene: hCG2033390
OMIM number: 107271

OMIM Information: CD59 ANTIGEN P18-20;CD59
Transcript SEQ ID NO: 866
Celera Transcript: hCT2336232

Peptide SEQ ID NO: 1385 (66-77) Tissue AS210 , ratio = 4.3

======

Protein SEQ ID NO: 195
Celera Protein: hCP1860967
Celera Gene: hCG2033390
OMIM number: 107271
OMIM Information: CD59 ANTIGEN P18-20;CD59
Transcript SEQ ID NO: 867
Celera Transcript: hCT2336234

Peptide SEQ ID NO: 1385 (93-104) Tissue AS210 , ratio = 4.3

======

Protein SEQ ID NO: 196
Public Protein Accession: P13987
Protein Name: Human CD59 protein
Transcript SEQ ID NO: 868
Public Transcript Accession: M84348

Protein SEQ ID NO: 197
Celera Protein: hCP1860969
Celera Gene: hCG2033390
OMIM number: 107271
OMIM Information: CD59 ANTIGEN P18-20;CD59
Transcript SEQ ID NO: 869
Celera Transcript: hCT2336233

Peptide SEQ ID NO: 1385 (66-77) Tissue AS210 , ratio = 4.3

======

Protein SEQ ID NO: 198
Celera Protein: hCP1777420
Celera Gene: hCG1783634.2
OMIM number: 600718
OMIM Information: TUMOR-ASSOCIATED CALCIUM SIGNAL TRANSDUCER 1;TACSTD1
Transcript SEQ ID NO: 870
Celera Transcript: hCT1962959.1

Peptide SEQ ID NO: 1372 (205-213) Tissue AS210 , ratio = 5.5

======

Protein SEQ ID NO: 199
Celera Protein: hCP1702182.1
Celera Gene: hCG1783634.2
OMIM number: 600718
OMIM Information: TUMOR-ASSOCIATED CALCIUM SIGNAL TRANSDUCER 1;TACSTD1
Transcript SEQ ID NO: 871
Celera Transcript: hCT1822578.2

Protein SEQ ID NO: 200
Public Protein Accession: P16422
Protein Name: Tumor-associated calcium signal transducer 1 precursor (Major gastrointestinal tumor-associated protein GA733-2) (Epithelial cell surface antigen) (Epithelial glycoprotein) (EGP) (Adenocarcinoma- associated antigen) (KSA) (KS 1/4 antigen) (Cell surface glycoprotein Trop-1)
Transcript SEQ ID NO: 872
Public Transcript Accession: M32325

Peptide SEQ ID NO: 1372 (129-137) Tissue AS210 , ratio = 5.5

======

Protein SEQ ID NO: 201
Public Protein Accession: NP_000933.1
Protein Name: Peptidylprolyl isomerase B (EC 5.2.1.8) (Cyclophilin B) (Peptidyl- prolyl cis-trans isomerase) (PPIase) (Rotamase)
Transcript SEQ ID NO: 873
Public Transcript Accession: NM_000942

Protein SEQ ID NO: 202
Celera Protein: hCP1783346.1
Celera Gene: hCG33347.4
OMIM number: 123841
OMIM Information: PEPTIDYLPROLYL ISOMERASE B;PPIB -continued Transcript SEQ ID NO: 874
Celera Transcript: hCT1971179.1

Peptide SEQ ID NO: 1371 (190-203) Tissue GW215 , ratio = Singleton

======

Protein SEQ ID NO: 203
Public Protein Accession: P23284
Protein Name: Peptidyl-prolyl cis-trans isomerase B precursor (EC 5.2.1.8) (PPIase) (Rotamase) (Cyclophilin B) (S-cyclophilin) (SCYLP) (CYP-S1)
Transcript SEQ ID NO: 875
Public Transcript Accession: M60457

Peptide SEQ ID NO: 1371 (182-195) Tissue GW215 , ratio = Singleton

======

Protein SEQ ID NO: 204
Celera Protein: hCP46698.2
Celera Gene: hCG33347.4
OMIM number: 123841
OMIM Information: PEPTIDYLPROLYL ISOMERASE B;PPIB
Transcript SEQ ID NO: 876
Celera Transcript: hCT24543.4

Peptide SEQ ID NO: 1371 (190-203) Tissue GW215 , ratio = Singleton

======

Protein SEQ ID NO: 205
Public Protein Accession: P02675
Protein Name: Fibrinogen beta chain precursor [Contains: Fibrinopeptide B]
Transcript SEQ ID NO: 877
Public Transcript Accession: M64983

Peptide SEQ ID NO: 1475 (224-238) Tissue AS210 , ratio = Singleton

======

Protein SEQ ID NO: 206
Celera Protein: hCP1913231
Celera Gene: hCG2026446
OMIM number: 134830
OMIM Information: FIBRINOGEN, B BETA POLYPEPTIDE;FGB
Transcript SEQ ID NO: 878
Celera Transcript: hCT2347980

Peptide SEQ ID NO: 1475 (124-138) Tissue AS210 , ratio = Singleton

======

Protein SEQ ID NO: 207
Celera Protein: hCP1887949
Celera Gene: hCG2026446
OMIM number: 134830
OMIM Information: FIBRINOGEN, B BETA POLYPEPTIDE;FGB
Transcript SEQ ID NO: 879
Celera Transcript: hCT2325438.1

Protein SEQ ID NO: 208
Celera Protein: hCP1887947
Celera Gene: hCG2026446
OMIM number: 134830
OMIM Information: FIBRINOGEN, B BETA POLYPEPTIDE;FGB
Transcript SEQ ID NO: 880
Celera Transcript: hCT2325436

Peptide SEQ ID NO: 1475 (224-238) Tissue AS210 , ratio = Singleton

======

Protein SEQ ID NO: 209
Celera Protein: hCP1913227
Celera Gene: hCG2026446
OMIM number: 134830
OMIM Information: FIBRINOGEN, B BETA POLYPEPTIDE;FGB
Transcript SEQ ID NO: 881
Celera Transcript: hCT2347979

Peptide SEQ ID NO: 1475 (77-91) Tissue AS210 , ratio = Singleton

======

Protein SEQ ID NO: 210
Celera Protein: hCP1887950.1
Celera Gene: hCG2026446
OMIM number: 134830
OMIM Information: FIBRINOGEN, B BETA POLYPEPTIDE;FGB
Transcript SEQ ID NO: 882
Celera Transcript: hCT2325437.1

Peptide SEQ ID NO: 1475 (193-207) Tissue AS210 , ratio = Singleton

======

Protein SEQ ID NO: 211
Celera Protein: hCP1913228
Celera Gene: hCG2026446
OMIM number: 134830
OMIM Information: FIBRINOGEN, B BETA POLYPEPTIDE;FGB
Transcript SEQ ID NO: 883
Celera Transcript: hCT2347978

Peptide SEQ ID NO: 1475 (77-91) Tissue AS210 , ratio = Singleton

======

Protein SEQ ID NO: 212
Celera Protein: hCP1887948.1
Celera Gene: hCG2026446
OMIM number: 134830
OMIM Information: FIBRINOGEN, B BETA POLYPEPTIDE;FGB
Transcript SEQ ID NO: 884
Celera Transcript: hCT2325435.1

Peptide SEQ ID NO: 1475 (165-179) Tissue AS210 , ratio = Singleton

======

Protein SEQ ID NO: 213
Public Protein Accession: NP_005132.1
Protein Name: fibrinogen, beta chain preproprotein [Homo sapiens]
Transcript SEQ ID NO: 885
Public Transcript Accession: NM_005141

Protein SEQ ID NO: 214
Celera Protein: hCP1913232
Celera Gene: hCG2026446
OMIM number: 134830
OMIM Information: FIBRINOGEN, B BETA POLYPEPTIDE;FGB
Transcript SEQ ID NO: 886
Celera Transcript: hCT2347981

Peptide SEQ ID NO: 1475 (224-238) Tissue AS210 , ratio = Singleton

======

Protein SEQ ID NO: 215
Celera Protein: hCP1913229
Celera Gene: hCG2026446
OMIM number: 134830
OMIM Information: FIBRINOGEN, B BETA POLYPEPTIDE;FGB
Transcript SEQ ID NO: 887
Celera Transcript: hCT2347977

Peptide SEQ ID NO: 1475 (190-204) Tissue AS210 , ratio = Singleton

======

Protein SEQ ID NO: 216
Celera Protein: hCP1783141
Celera Gene: hCG28148.4
OMIM number: 185630
OMIM Information: SURFEIT 2;SURF2
Transcript SEQ ID NO: 888
Celera Transcript: hCT1971125.1

Peptide SEQ ID NO: 1429 (114-126) Tissue AS210 , ratio = 6.5

======

Protein SEQ ID NO: 217
Public Protein Accession: O15260
Protein Name: Surfeit locus protein 4
Transcript SEQ ID NO: 889
Public Transcript Accession: BC018741

Peptide SEQ ID NO: 1429 (30-42) Tissue AS210 , ratio = 6.5

======

Protein SEQ ID NO: 218
Public Protein Accession: XP_372178.1
Protein Name: similar to Surfeit locus protein 4 [Homo sapiens]

Peptide SEQ ID NO: 1429 (94-106) Tissue AS210 , ratio = 6.5

======

Protein SEQ ID NO: 219
Celera Protein: hCP43628
Celera Gene: hCG28148.4
OMIM number: 185630
OMIM Information: SURFEIT 2;SURF2
Transcript SEQ ID NO: 890
Celera Transcript: hCT19294.3

Peptide SEQ ID NO: 1429 (30-42) Tissue AS210 , ratio = 6.5

======

Protein SEQ ID NO: 220
Celera Protein: hCP1783145
Celera Gene: hCG28148.4
OMIM number: 185630
OMIM Information: SURFEIT 2;SURF2
Transcript SEQ ID NO: 891
Celera Transcript: hCT1971129.1

Peptide SEQ ID NO: 1429 (51-63) Tissue AS210 , ratio = 6.5

======

Protein SEQ ID NO: 221
Celera Protein: hCP1799481
Celera Gene: hCG22206.2
OMIM number: 125240
OMIM Information: DECAY-ACCELERATING FACTOR FOR COMPLEMENT;DAF
Transcript SEQ ID NO: 892
Celera Transcript: hCT2262673

Peptide SEQ ID NO: 1457 (78-84) Tissue AS210 , ratio = Singleton

======

Protein SEQ ID NO: 222
Celera Protein: hCP1799482
Celera Gene: hCG22206.2
OMIM number: 125240
OMIM Information: DECAY-ACCELERATING FACTOR FOR COMPLEMENT;DAF
Transcript SEQ ID NO: 893
Celera Transcript: hCT2262675

Protein SEQ ID NO: 223
Celera Protein: hCP39714.2
Celera Gene: hCG22206.2
OMIM number: 125240
OMIM Information: DECAY-ACCELERATING FACTOR FOR COMPLEMENT;DAF
Transcript SEQ ID NO: 894
Celera Transcript: hCT13299.2

Peptide SEQ ID NO: 1457 (96-102) Tissue AS210 , ratio = Singleton

======

Protein SEQ ID NO: 224
Celera Protein: hCP1799476
Celera Gene: hCG22206.2
OMIM number: 125240
OMIM Information: DECAY-ACCELERATING FACTOR FOR COMPLEMENT;DAF Transcript SEQ ID NO: 895
Celera Transcript: hCT2262667

Peptide SEQ ID NO: 1457 (78-84) Tissue AS210 , ratio = Singleton

======

Protein SEQ ID NO: 225
Celera Protein: hCP1799477
Celera Gene: hCG22206.2
OMIM number: 125240
OMIM Information: DECAY-ACCELERATING FACTOR FOR COMPLEMENT;DAF
Transcript SEQ ID NO: 896
Celera Transcript: hCT2262672

Peptide SEQ ID NO: 1457 (96-102) Tissue AS210 , ratio = Singleton

======

Protein SEQ ID NO: 226
Celera Protein: hCP1799478
Celera Gene: hCG22206.2
OMIM number: 125240
OMIM Information: DECAY-ACCELERATING FACTOR FOR COMPLEMENT;DAF
Transcript SEQ ID NO: 897
Celera Transcript: hCT2262668

Peptide SEQ ID NO: 1457 (78-84) Tissue AS210 , ratio = Singleton

======

Protein SEQ ID NO: 227
Public Protein Accession: P08174
Protein Name: Complement decay-accelerating factor precursor (CD55 antigen)

Protein SEQ ID NO: 228
Celera Protein: hCP1799473
Celera Gene: hCG22206.2
OMIM number: 125240
OMIM Information: DECAY-ACCELERATING FACTOR FOR COMPLEMENT;DAF
Transcript SEQ ID NO: 898
Celera Transcript: hCT2262674

Peptide SEQ ID NO: 1457 (96-102) Tissue AS210 , ratio = Singleton

======

Protein SEQ ID NO: 229
Celera Protein: hCP1799480
Celera Gene: hCG22206.2
OMIM number: 125240
OMIM Information: DECAY-ACCELERATING FACTOR FOR COMPLEMENT;DAF
Transcript SEQ ID NO: 899
Celera Transcript: hCT2262670

Protein SEQ ID NO: 230
Celera Protein: hCP1799479
Celera Gene: hCG22206.2
OMIM number: 125240
OMIM Information: DECAY-ACCELERATING FACTOR FOR COMPLEMENT;DAF
Transcript SEQ ID NO: 900
Celera Transcript: hCT2262669

Protein SEQ ID NO: 231
Celera Protein: hCP1799475
Celera Gene: hCG22206.2
OMIM number: 125240
OMIM Information: DECAY-ACCELERATING FACTOR FOR COMPLEMENT;DAF
Transcript SEQ ID NO: 901
Celera Transcript: hCT2262666

Peptide SEQ ID NO: 1457 (78-84) Tissue AS210 , ratio = Singleton

======

Protein SEQ ID NO: 232
Celera Protein: hCP49036.2
Celera Gene: hCG39152.2
OMIM number: 114070
OMIM Information: ANNEXIN A6;ANXA6

-continued

Transcript SEQ ID NO: 902
Celera Transcript: hCT30398.3

Protein SEQ ID NO: 233
Celera Protein: hCP1894239
Celera Gene: hCG39152.2
OMIM number: 114070
OMIM Information: ANNEXIN A6;ANXA6
Transcript SEQ ID NO: 903
Celera Transcript: hCT2253169

Protein SEQ ID NO: 234
Public Protein Accession: NP_004024.1
Protein Name: annexin VI isoform 2; annexin VI (p68); calcium-binding protein p68; calphobindin II; calelectrin [Homo sapiens]
Transcript SEQ ID NO: 904
Public Transcript Accession: NM_004033

Protein SEQ ID NO: 235
Celera Protein: hCP1894241
Celera Gene: hCG39152.2
OMIM number: 114070
OMIM Information: ANNEXIN A6;ANXA6
Transcript SEQ ID NO: 905
Celera Transcript: hCT2253168

Peptide SEQ ID NO: 1358 (113-121) Tissue AS210 , ratio = Singleton

======

Protein SEQ ID NO: 236
Public Protein Accession: P08133
Protein Name: Annexin VI (Lipocortin VI) (P68) (P70) (Protein III) (Chromobindin 20) (67 kDa calelectrin) (Calphobindin-II) (CPB-II)
Transcript SEQ ID NO: 906
Public Transcript Accession: D00510

Peptide SEQ ID NO: 1358 (112-120) Tissue AS210 , ratio = Singleton

======

Protein SEQ ID NO: 237
Celera Protein: hCP1873931
Celera Gene: hCG1985937
OMIM number: 114217
OMIM Information: CALNEXIN;CANX
Transcript SEQ ID NO: 907
Celera Transcript: hCT2261071

Protein SEQ ID NO: 238
Public Protein Accession: P27824
Protein Name: Calnexin precursor (Major histocompatibility complex class I antigen-binding protein p88) (p90) (IP90)
Transcript SEQ ID NO: 908
Public Transcript Accession: AJ271880

Protein SEQ ID NO: 239
Celera Protein: hCP1873932
Celera Gene: hCG1985937
OMIM number: 114217
OMIM Information: CALNEXIN;CANX
Transcript SEQ ID NO: 909
Celera Transcript: hCT2261070

Peptide SEQ ID NO: 1438 (134-165) Tissue AS210 , ratio = Singleton

======

Protein SEQ ID NO: 240
Celera Protein: hCP1880643
Celera Gene: hCG2016483
Transcript SEQ ID NO: 910
Celera Transcript: hCT2309390

Protein SEQ ID NO: 241
Public Protein Accession: Q15185
Protein Name: Amino acid sequence of a human prostaglandin E1 (PGE1) synthase
Transcript SEQ ID NO: 911
Public Transcript Accession: L24804

Peptide SEQ ID NO: 1406 (48-64) Tissue AS210 , ratio = Singleton

======

-continued

Protein SEQ ID NO: 242
Celera Protein: hCP1880644
Celera Gene: hCG2016483
Transcript SEQ ID NO: 912
Celera Transcript: hCT2309391

Peptide SEQ ID NO: 1406 (52-68) Tissue AS210 , ratio = Singleton

======

Protein SEQ ID NO: 243
Celera Protein: hCP1880641
Celera Gene: hCG2016483
Transcript SEQ ID NO: 913
Celera Transcript: hCT2309388

Protein SEQ ID NO: 244
Celera Protein: hCP1880645
Celera Gene: hCG2016483
Transcript SEQ ID NO: 914
Celera Transcript: hCT2309389

Peptide SEQ ID NO: 1406 (48-64) Tissue AS210 , ratio = Singleton

======

Protein SEQ ID NO: 245
Celera Protein: hCP1795110
Celera Gene: hCG18559.3
OMIM number: 600181
OMIM Information: LIPOCALIN 2;LCN2
Transcript SEQ ID NO: 915
Celera Transcript: hCT2317808

Peptide SEQ ID NO: 1472 (150-166) Tissue GW215 , ratio = Singleton
Peptide SEQ ID NO: 1466 (226-246) Tissue GW215 , ratio = Singleton

======

Protein SEQ ID NO: 246
Celera Protein: hCP36745.1
Celera Gene: hCG18559.3
OMIM number: 600181
OMIM Information: LIPOCALIN 2;LCN2
Transcript SEQ ID NO: 916
Celera Transcript: hCT9618.3

Peptide SEQ ID NO: 1472 (101-117) Tissue GW215 , ratio = Singleton
Peptide SEQ ID NO: 1466 (177-197) Tissue GW215 , ratio = Singleton

======

Protein SEQ ID NO: 247
Celera Protein: hCP1795108
Celera Gene: hCG18559.3
OMIM number: 600181
OMIM Information: LIPOCALIN 2;LCN2
Transcript SEQ ID NO: 917
Celera Transcript: hCT2317810

Protein SEQ ID NO: 248
Public Protein Accession: NP_005555.1
Protein Name: Human ovarian cancer marker OV37
Transcript SEQ ID NO: 918
Public Transcript Accession: NM_005564

Peptide SEQ ID NO: 1472 (101-117) Tissue GW215 , ratio = Singleton

======

Protein SEQ ID NO: 249
Celera Protein: hCP1795107
Celera Gene: hCG18559.3
OMIM number: 600181
OMIM Information: LIPOCALIN 2;LCN2
Transcript SEQ ID NO: 919
Celera Transcript: hCT2317805

Peptide SEQ ID NO: 1472 (150-166) Tissue GW215 , ratio = Singleton

======

Protein SEQ ID NO: 250
Public Protein Accession: P80188
Protein Name: Human neutrophil gelatinase associated protein (NGAL)
Transcript SEQ ID NO: 920
Public Transcript Accession: BC033089

Peptide SEQ ID NO: 1472 (101-117) Tissue GW215 , ratio = Singleton
Peptide SEQ ID NO: 1466 (177-197) Tissue GW215 , ratio = Singleton

======

Protein SEQ ID NO: 251
Public Protein Accession: NP_872271.1
Protein Name: pyruvate kinase 3 isoform 2; thyroid hormone-binding protein, cytosolic; PK, muscle type; OPA-interacting protein 3 [Homo sapiens]
Transcript SEQ ID NO: 921
Public Transcript Accession: NM_182471

Peptide SEQ ID NO: 1396 (467-474) Tissue GW215 , ratio = Singleton

======

Protein SEQ ID NO: 252
Celera Protein: hCP1879418
Celera Gene: hCG2005199
Transcript SEQ ID NO: 922
Celera Transcript: hCT2291827

Peptide SEQ ID NO: 1396 (502-509) Tissue GW215 , ratio = Singleton

======

Protein SEQ ID NO: 253
Celera Protein: hCP1879415
Celera Gene: hCG2005199
Transcript SEQ ID NO: 923
Celera Transcript: hCT2291828

Peptide SEQ ID NO: 1396 (467-474) Tissue GW215 , ratio = Singleton

======

Protein SEQ ID NO: 254
Celera Protein: hCP1879417
Celera Gene: hCG2005199
Transcript SEQ ID NO: 924
Celera Transcript: hCT2291830

Peptide SEQ ID NO: 1396 (488-495) Tissue GW215 , ratio = Singleton

======

Protein SEQ ID NO: 255
Public Protein Accession: NP_002645.1
Protein Name: Pyruvate kinase
Transcript SEQ ID NO: 925
Public Transcript Accession: NM_002654

Protein SEQ ID NO: 256
Celera Protein: hCP1879419
Celera Gene: hCG2005199
Transcript SEQ ID NO: 926
Celera Transcript: hCT2291824

Peptide SEQ ID NO: 1396 (467-474) Tissue GW215 , ratio = Singleton

======

Protein SEQ ID NO: 257
Public Protein Accession: P14786
Protein Name: Pyruvate kinase, M2 isozyme (EC 2.7.1.40)
Transcript SEQ ID NO: 927
Public Transcript Accession: M23725

Peptide SEQ ID NO: 1396 (466-473) Tissue GW215 , ratio = Singleton

======

-continued

Protein SEQ ID NO: 258
Celera Protein: hCP1879421
Celera Gene: hCG2005199
Transcript SEQ ID NO: 928
Celera Transcript: hCT2291825

Peptide SEQ ID NO: 1396 (138-145) Tissue GW215 , ratio = Singleton

======

Protein SEQ ID NO: 259
Public Protein Accession: P14618
Protein Name: Pyruvate kinase, M1 isozyme (EC 2.7.1.40) (Pyruvate kinase muscle isozyme) (Cytosolic thyroid hormone-binding protein) (CTHBP) (THBP1)
Transcript SEQ ID NO: 929
Public Transcript Accession: BC007640

Peptide SEQ ID NO: 1396 (466-473) Tissue GW215 , ratio = Singleton

======

Protein SEQ ID NO: 260
Celera Protein: hCP1761383
Celera Gene: hCG1810977.1
Transcript SEQ ID NO: 930
Celera Transcript: hCT1950961.1

Peptide SEQ ID NO: 1396 (85-92) Tissue GW215 , ratio = Singleton

======

Protein SEQ ID NO: 261
Celera Protein: hCP1879420
Celera Gene: hCG2005199
Transcript SEQ ID NO: 931
Celera Transcript: hCT2291829

Peptide SEQ ID NO: 1396 (138-145) Tissue GW215 , ratio = Singleton

======

Protein SEQ ID NO: 262
Celera Protein: hCP1911332
Celera Gene: hCG2041113
Transcript SEQ ID NO: 932
Celera Transcript: hCT2346344

Peptide SEQ ID NO: 1396 (5-12) Tissue GW215 , ratio = Singleton

======

Protein SEQ ID NO: 263
Celera Protein: hCP39579.2
Celera Gene: hCG22111.3
Transcript SEQ ID NO: 933
Celera Transcript: hCT13204.3

Peptide SEQ ID NO: 1396 (18-25) Tissue GW215 , ratio = Singleton

======

Protein SEQ ID NO: 264
Public Protein Accession: Q9NZ08
Protein Name: Adipocyte-derived leucine aminopeptidase precursor (EC 3.4.11.-) (A- LAP) (ARTS-1) (Aminopeptidase PILS) (Puromycin-insensitive leucyl- specific aminopeptidase) (PILS-AP) (Type 1 tumor necrosis factor receptor shedding aminopeptidase regulator)

Peptide SEQ ID NO: 1392 (428-436) Tissue AS210 , ratio = 2.9

======

Protein SEQ ID NO: 265
Celera Protein: hCP1807285
Celera Gene: hCG1735555.1
OMIM number: 114090
OMIM Information: CALPASTATIN;CAST
Transcript SEQ ID NO: 934
Celera Transcript: hCT2309745

Protein SEQ ID NO: 266
Celera Protein: hCP1731110.1

-continued

Celera Gene: hCG1735555.1
OMIM number: 114090
OMIM Information: CALPASTATIN;CAST
Transcript SEQ ID NO: 935
Celera Transcript: hCT1773556.1

Protein SEQ ID NO: 267
Celera Protein: hCP1731124.1
Celera Gene: hCG1735555.1
OMIM number: 114090
OMIM Information: CALPASTATIN;CAST
Transcript SEQ ID NO: 936
Celera Transcript: hCT1773554.1

Protein SEQ ID NO: 268
Public Protein Accession: NP_057526.2
Protein Name: type 1 tumor necrosis factor receptor shedding aminopeptidase regulator; adipocyte-derived leucine aminopeptidase; aminopeptidase PILS [Homo sapiens]
Transcript SEQ ID NO: 937
Public Transcript Accession: NM_016442

Peptide SEQ ID NO: 1392 (440-448) Tissue AS210 , ratio = 2.9

======

Protein SEQ ID NO: 269
Celera Protein: hCP38708.2
Celera Gene: hCG21109.3
OMIM number: 602950
OMIM Information: HETEROGENEOUS NUCLEAR RIBONUCLEOPROTEIN METHYLTRANSFERASE 1-LIKE 2;HRMT1L2
Transcript SEQ ID NO: 938
Celera Transcript: hCT12195.3

Peptide SEQ ID NO: 1456 (243-252) Tissue GW215 , ratio = Singleton
Peptide SEQ ID NO: 1482 (261-275) Tissue GW215 , ratio = Singleton
Peptide SEQ ID NO: 1488 (113-127) Tissue GW215 , ratio = Singleton

======

Protein SEQ ID NO: 270
Celera Protein: hCP1771483
Celera Gene: hCG21109.3
OMIM number: 602950
OMIM Information: HETEROGENEOUS NUCLEAR RIBONUCLEOPROTEIN METHYLTRANSFERASE 1-LIKE 2;HRMT1L2
Transcript SEQ ID NO: 939
Celera Transcript: hCT1960270.1

Peptide SEQ ID NO: 1456 (225-234) Tissue GW215 , ratio = Singleton
Peptide SEQ ID NO: 1482 (243-257) Tissue GW215 , ratio = Singleton
Peptide SEQ ID NO: 1488 (95-109) Tissue GW215 , ratio = Singleton

======

Protein SEQ ID NO: 271
Public Protein Accession: NP_001527.1
Protein Name: Human expressed protein tag (EPT) #1256
Transcript SEQ ID NO: 940
Public Transcript Accession: NM_001536

Peptide SEQ ID NO: 1456 (232-241) Tissue GW215 , ratio = Singleton
Peptide SEQ ID NO: 1482 (250-264) Tissue GW215 , ratio = Singleton

======

Protein SEQ ID NO: 272
Celera Protein: hCP1771486
Celera Gene: hCG21109.3
OMIM number: 602950
OMIM Information: HETEROGENEOUS NUCLEAR RIBONUCLEOPROTEIN METHYLTRANSFERASE 1-LIKE 2;HRMT1L2
Transcript SEQ ID NO: 941
Celera Transcript: hCT1960269.1

Peptide SEQ ID NO: 1456 (220-229) Tissue GW215 , ratio = Singleton
Peptide SEQ ID NO: 1482 (238-252) Tissue GW215 , ratio = Singleton
Peptide SEQ ID NO: 1488 (90-104) Tissue GW215 , ratio = Singleton

======

Protein SEQ ID NO: 273
Celera Protein: hCP1858945

-continued

Celera Gene: hCG21109.3
OMIM number: 602950
OMIM Information: HETEROGENEOUS NUCLEAR RIBONUCLEOPROTEIN METHYLTRANSFERASE 1-LIKE 2;HRMT1L2
Transcript SEQ ID NO: 942
Celera Transcript: hCT2280009

Peptide SEQ ID NO: 1456 (222-231) Tissue GW215 , ratio = Singleton
Peptide SEQ ID NO: 1482 (240-254) Tissue GW215 , ratio = Singleton
Peptide SEQ ID NO: 1488 (92-106) Tissue GW215 , ratio = Singleton

======

Protein SEQ ID NO: 274
Celera Protein: hCP51463.2
Celera Gene: hCG41587.2
Transcript SEQ ID NO: 943
Celera Transcript: hCT32859.2

Peptide SEQ ID NO: 1456 (77-86) Tissue GW215 , ratio = Singleton
Peptide SEQ ID NO: 1482 (95-109) Tissue GW215 , ratio = Singleton

======

Protein SEQ ID NO: 275
Public Protein Accession: Q99873
Protein Name: Human expressed protein tag (EPT) #1257
Transcript SEQ ID NO: 944
Public Transcript Accession: Y10806

Peptide SEQ ID NO: 1456 (233-242) Tissue GW215 , ratio = Singleton
Peptide SEQ ID NO: 1482 (251-265) Tissue GW215 , ratio = Singleton

======

Protein SEQ ID NO: 276
Celera Protein: hCP1734921.1
Celera Gene: hCG1778022.2
Transcript SEQ ID NO: 945
Celera Transcript: hCT1816776.1

Protein SEQ ID NO: 277
Public Protein Accession: NP_055545.1 Q14165
Protein Name: Hypothetical protein KIAA0152
Transcript SEQ ID NO: 946
Public Transcript Accession: NM_014730

Protein SEQ ID NO: 278
Celera Protein: hCP1765089.1
Celera Gene: hCG1778022.2
Transcript SEQ ID NO: 947
Celera Transcript: hCT1955412.1

Peptide SEQ ID NO: 1481 (204-219) Tissue AS210 , ratio = 4.2

======

Protein SEQ ID NO: 279
Celera Protein: hCP37167.2
Celera Gene: hCG19001.3
OMIM number: 140572
OMIM Information: HEAT-SHOCK 90-KD PROTEIN 1, BETA;HSPCB
Transcript SEQ ID NO: 948
Celera Transcript: hCT10066.3

Peptide SEQ ID NO: 1339 (557-564) Tissue AS210 , ratio = Singleton

======

Protein SEQ ID NO: 280
Celera Protein: hCP1604769.3
Celera Gene: hCG1641272.3
Transcript SEQ ID NO: 949
Celera Transcript: hCT1641399.2

Peptide SEQ ID NO: 1339 (5-12) Tissue AS210 , ratio = Singleton

======

Protein SEQ ID NO: 281
Celera Protein: hCP1853519

-continued

Celera Gene: hCG19001.3
OMIM number: 140572
OMIM Information: HEAT-SHOCK 90-KD PROTEIN 1, BETA;HSPCB
Transcript SEQ ID NO: 950
Celera Transcript: hCT2285894.1

Peptide SEQ ID NO: 1339 (557-564) Tissue AS210 , ratio = Singleton

======

Protein SEQ ID NO: 282
Public Protein Accession: P08238
Protein Name: Heat shock protein HSP 90-beta (HSP 84) (HSP 90)
Transcript SEQ ID NO: 951
Public Transcript Accession: BC014485

Peptide SEQ ID NO: 1339 (556-563) Tissue AS210 , ratio = Singleton

======

Protein SEQ ID NO: 283
Celera Protein: hCP1907792
Celera Gene: hCG2036899
Transcript SEQ ID NO: 952
Celera Transcript: hCT2341208

Peptide SEQ ID NO: 1339 (5-12) Tissue AS210 , ratio = Singleton

======

Protein SEQ ID NO: 284
Public Protein Accession: P11479
Protein Name: Human defensin 1
Transcript SEQ ID NO: 953
Public Transcript Accession: M21130

Protein SEQ ID NO: 285
Public Protein Accession: NP_005208.1 P59666
Protein Name: Neutrophil defensin 3 precursor (HNP-3) (HP-3) (HP3) (Defensin, alpha 3) [Contains: HP 3-56; Neutrophil defensin 2 (HNP-2) (HP-2) (HP2)]
Transcript SEQ ID NO: 954
Public Transcript Accession: NM_005217

Peptide SEQ ID NO: 1496 (79-87) Tissue AS210 , ratio = 21.2
Peptide SEQ ID NO: 1418 (69-77) Tissue AS210 , ratio = 6.7

======

Protein SEQ ID NO: 286
Celera Protein: hCP1781379
Celera Gene: hCG19171.3
OMIM number: 147556
OMIM Information: INTEGRIN, ALPHA-6;ITGA6
Transcript SEQ ID NO: 955
Celera Transcript: hCT1965781.1

Protein SEQ ID NO: 287
Celera Protein: hCP37078.2
Celera Gene: hCG19171.3
OMIM number: 147556
OMIM Information: INTEGRIN, ALPHA-6;ITGA6
Transcript SEQ ID NO: 956
Celera Transcript: hCT10236.3

Protein SEQ ID NO: 288
Celera Protein: hCP1691397.2
Celera Gene: hCG19171.3
OMIM number: 147556
OMIM Information: INTEGRIN, ALPHA-6;ITGA6
Transcript SEQ ID NO: 957
Celera Transcript: hCT1687205.4

Protein SEQ ID NO: 289
Public Protein Accession: P23229
Protein Name: Human expressed protein tag (EPT) #939

Protein SEQ ID NO: 290
Public Protein Accession: NP_000201.1
Protein Name: Human alpha6 integrin protein
Transcript SEQ ID NO: 958

Public Transcript Accession: NM_000210

Peptide SEQ ID NO: 1473 (79-90) Tissue AS210 , ratio = 2.4

======

Protein SEQ ID NO: 291
Celera Protein: hCP1789007
Celera Gene: hCG27538.2
OMIM number: 147557
OMIM Information: INTEGRIN, BETA-4;ITGB4
Transcript SEQ ID NO: 959
Celera Transcript: hCT2262896

Protein SEQ ID NO: 292
Celera Protein: hCP1789003
Celera Gene: hCG27538.2
OMIM number: 147557
OMIM Information: INTEGRIN, BETA-4;ITGB4
Transcript SEQ ID NO: 960
Celera Transcript: hCT2262903

Protein SEQ ID NO: 293
Celera Protein: hCP1789006
Celera Gene: hCG27538.2
OMIM number: 147557
OMIM Information: INTEGRIN, BETA-4;ITGB4
Transcript SEQ ID NO: 961
Celera Transcript: hCT2262898

Protein SEQ ID NO: 294
Celera Protein: hCP1769925
Celera Gene: hCG27538.2
OMIM number: 147557
OMIM Information: INTEGRIN, BETA-4;ITGB4
Transcript SEQ ID NO: 962
Celera Transcript: hCT1813723.1

Protein SEQ ID NO: 295
Public Protein Accession: NP_000204.2
Protein Name: Beta subunit of integrin cell surface receptor
Transcript SEQ ID NO: 963
Public Transcript Accession: NM_000213

Protein SEQ ID NO: 296
Celera Protein: hCP1789009
Celera Gene: hCG27538.2
OMIM number: 147557
OMIM Information: INTEGRIN, BETA-4;ITGB4
Transcript SEQ ID NO: 964
Celera Transcript: hCT2262904

Protein SEQ ID NO: 297
Celera Protein: hCP1789008
Celera Gene: hCG27538.2
OMIM number: 147557
OMIM Information: INTEGRIN, BETA-4;ITGB4
Transcript SEQ ID NO: 965
Celera Transcript: hCT2262901

Protein SEQ ID NO: 298
Celera Protein: hCP1769924
Celera Gene: hCG27538.2
OMIM number: 147557
OMIM Information: INTEGRIN, BETA-4;ITGB4
Transcript SEQ ID NO: 966
Celera Transcript: hCT1813724.1

Protein SEQ ID NO: 299
Celera Protein: hCP43087.2
Celera Gene: hCG27538.2
OMIM number: 147557
OMIM Information: INTEGRIN, BETA-4;ITGB4
Transcript SEQ ID NO: 967
Celera Transcript: hCT18677.2

Protein SEQ ID NO: 300
Public Protein Accession: P16144
Protein Name: Integrin beta-4 precursor (GP150) (CD104 antigen)

-continued

Protein SEQ ID NO: 301
Celera Protein: hCP1789004
Celera Gene: hCG27538.2
OMIM number: 147557
OMIM Information: INTEGRIN, BETA-4;ITGB4
Transcript SEQ ID NO: 968
Celera Transcript: hCT2262900

Peptide SEQ ID NO: 1340 (413-430) Tissue AS210 , ratio = 3.2

======

Protein SEQ ID NO: 302
Public Protein Accession: P21912
Protein Name: Succinate dehydrogenase [ubiquinone] iron-sulfur protein mitochondrial precursor (EC 1.3.5.1) (Ip) (Iron-sulfur subunit of complex II)
Transcript SEQ ID NO: 969
Public Transcript Accession: BC007840

Peptide SEQ ID NO: 1353 (67-77) Tissue AS210 , ratio = Singleton

======

Protein SEQ ID NO: 303
Celera Protein: hCP1765659.1
Celera Gene: hCG25123.2
OMIM number: 185470
OMIM Information: SUCCINATE DEHYDROGENASE COMPLEX, SUBUNIT B, IRON SULFUR PROTEIN;SDHB
Transcript SEQ ID NO: 970
Celera Transcript: hCT1955045.1

Peptide SEQ ID NO: 1353 (10-20) Tissue AS210 , ratio = Singleton

======

Protein SEQ ID NO: 304
Celera Protein: hCP42056.2
Celera Gene: hCG25123.2
OMIM number: 185470
OMIM Information: SUCCINATE DEHYDROGENASE COMPLEX, SUBUNIT B, IRON SULFUR PROTEIN;SDHB
Transcript SEQ ID NO: 971
Celera Transcript: hCT16247.2

Peptide SEQ ID NO: 1353 (67-77) Tissue AS210 , ratio = Singleton

======

Protein SEQ ID NO: 305
Celera Protein: hCP39515.2
Celera Gene: hCG22033.3
Transcript SEQ ID NO: 972
Celera Transcript: hCT13126.3

Peptide SEQ ID NO: 1471 (289-312) Tissue AS210 , ratio = Singleton

======

Protein SEQ ID NO: 306
Celera Protein: hCP1779051.1
Celera Gene: hCG22033.3
Transcript SEQ ID NO: 973
Celera Transcript: hCT1964369.1

Peptide SEQ ID NO: 1471 (108-131) Tissue AS210 , ratio = Singleton

======

Protein SEQ ID NO: 307
Public Protein Accession: NP_005733.1 Q15084
Protein Name: Protein disulfide isomerase A6 precursor (EC 5.3.4.1) (Protein disulfide isomerase P5)
Transcript SEQ ID NO: 974
Public Transcript Accession: NM_005742

Peptide SEQ ID NO: 1471 (289-312) Tissue AS210 , ratio = Singleton

======

Protein SEQ ID NO: 308
Public Protein Accession: NP_067050.1
Protein Name: DC2 (Hydrophobic protein HSF-28) (Hypothetical protein)
Transcript SEQ ID NO: 975

-continued

Public Transcript Accession: NM_021227

Protein SEQ ID NO: 309
Celera Protein: hCP1762298.1
Celera Gene: hCG21075.3
Transcript SEQ ID NO: 976
Celera Transcript: hCT1952232.1

Protein SEQ ID NO: 310
Celera Protein: hCP38649.2
Celera Gene: hCG21075.3
Transcript SEQ ID NO: 977
Celera Transcript: hCT12161.3

Peptide SEQ ID NO: 1491 (6-17) Tissue AS210 , ratio = 5.6

======

Protein SEQ ID NO: 311
Celera Protein: hCP1783149.1
Celera Gene: hCG93874.3
Transcript SEQ ID NO: 978
Celera Transcript: hCT1971258.1

Protein SEQ ID NO: 312
Public Protein Accession: Q9Y5L3
Protein Name: Ectonucleoside triphosphate diphosphohydrolase 2 (EC 3.6.1.3) (NTPDase2) (Ecto-ATPase) (CD39 antigen-like 1)
Transcript SEQ ID NO: 979
Public Transcript Accession: AF144748

Protein SEQ ID NO: 313
Celera Protein: hCP201394.2
Celera Gene: hCG93874.3
Transcript SEQ ID NO: 980
Celera Transcript: hCT85173.3

Peptide SEQ ID NO: 1434 (251-267) Tissue AS210 , ratio = 3.7

======

Protein SEQ ID NO: 314
Celera Protein: hCP1778449.1
Celera Gene: hCG14620.4
Transcript SEQ ID NO: 981
Celera Transcript: hCT1963109.1

Protein SEQ ID NO: 315
Celera Protein: hCP33245.2
Celera Gene: hCG14620.4
Transcript SEQ ID NO: 982
Celera Transcript: hCT5641.3

Peptide SEQ ID NO: 1500 (161-173) Tissue AS210 , ratio = Singleton

======

Protein SEQ ID NO: 316
Celera Protein: hCP1778443.1
Celera Gene: hCG14620.4
Transcript SEQ ID NO: 983
Celera Transcript: hCT1963108.1

Peptide SEQ ID NO: 1500 (195-207) Tissue AS210 , ratio = Singleton

======

Protein SEQ ID NO: 317
Public Protein Accession: NP_006401.2
Protein Name: Tat-interacting protein (30kD) (HIV-1 Tat interactive protein 2, 30 kDa)
Transcript SEQ ID NO: 984
Public Transcript Accession: NM_006410

Peptide SEQ ID NO: 1500 (161-173) Tissue AS210 , ratio = Singleton

======

Protein SEQ ID NO: 318
Celera Protein: hCP1888125
Celera Gene: hCG16144.2
OMIM number: 103220

-continued

OMIM Information: SOLUTE CARRIER FAMILY 25, MEMBER 4;SLC25A4
Transcript SEQ ID NO: 985
Celera Transcript: hCT2324385

Protein SEQ ID NO: 319
Celera Protein: hCP33603.2
Celera Gene: hCG16144.2
OMIM number: 103220
OMIM Information: SOLUTE CARRIER FAMILY 25, MEMBER 4;SLC25A4
Transcript SEQ ID NO: 986
Celera Transcript: hCT7175.2

Peptide SEQ ID NO: 1374 (152-162) Tissue NS216 , ratio = 3.0

======

Protein SEQ ID NO: 320
Public Protein Accession: NP_001142.1
Protein Name: solute carrier family 25 (mitochondrial carrier; adenine nucleotide translocator), member 4; adenine nucleotide translocator 1 (skeletal muscle) [Homo sapiens]
Transcript SEQ ID NO: 987
Public Transcript Accession: NM_001151

Peptide SEQ ID NO: 1374 (151-161) Tissue NS216 , ratio = 3.0

======

Protein SEQ ID NO: 321
Public Protein Accession: P12235
Protein Name: ADP,ATP carrier protein, heart/skeletal muscle isoform T1 (ADP/ATP translocase 1) (Adenine nucleotide translocator 1) (ANT 1)
Transcript SEQ ID NO: 988
Public Transcript Accession: BC008664

Peptide SEQ ID NO: 1374 (152-162) Tissue NS216 , ratio = 3.0

======

Protein SEQ ID NO: 322
Public Protein Accession: P01861
Protein Name: Human Ig-G4 heavy chain constant region amino acid sequence Peptide SEQ ID NO: 1453 (240-249) Tissue AS210 , ratio = Singleton

======

Protein SEQ ID NO: 323
Public Protein Accession: NP_940924.1
Protein Name: FLJ27099 protein [Homo sapiens]
Transcript SEQ ID NO: 989
Public Transcript Accession: NM_198522

Peptide SEQ ID NO: 1453 (385-394) Tissue AS210 , ratio = Singleton

======

Protein SEQ ID NO: 324
Public Protein Accession: P01859
Protein Name: Human Ig-G2 heavy chain constant region amino acid sequence Peptide SEQ ID NO: 1453 (239-248) Tissue AS210 , ratio = Singleton

======

Protein SEQ ID NO: 325
Public Protein Accession: P01860
Protein Name: Ig gamma-3 chain C region (Heavy chain disease protein) (HDC)

Peptide SEQ ID NO: 1453 (203-212) Tissue AS210 , ratio = Singleton

======

Protein SEQ ID NO: 326
Celera Protein: hCP1868274
Celera Gene: hCG2038936
Transcript SEQ ID NO: 990
Celera Transcript: hCT2330789.1

Peptide SEQ ID NO: 1453 (289-298) Tissue AS210 , ratio = Singleton

======

-continued

Protein SEQ ID NO: 327
Celera Protein: hCP1850002
Celera Gene: hCG2003479
Transcript SEQ ID NO: 991
Celera Transcript: hCT2288987

Peptide SEQ ID NO: 1453 (109-118) Tissue AS210 , ratio = Singleton

======

Protein SEQ ID NO: 328
Public Protein Accession: XP_370784.1
Protein Name: FLJ27099 protein [Homo sapiens]

Peptide SEQ ID NO: 1453 (273-282) Tissue AS210 , ratio = Singleton

======

Protein SEQ ID NO: 329
Public Protein Accession: P01857
Protein Name: Human Ig-gamma1 heavy chain constant region amino acid sequence Peptide SEQ ID NO: 1453 (243-252) Tissue AS210 , ratio = Singleton

======

Protein SEQ ID NO: 330
Celera Protein: hCP1868284
Celera Gene: hCG2029987.1
Transcript SEQ ID NO: 992
Celera Transcript: hCT2330790.1

Peptide SEQ ID NO: 1453 (242-251) Tissue AS210 , ratio = Singleton

======

Protein SEQ ID NO: 331
Celera Protein: hCP1802459
Celera Gene: hCG1996846
Transcript SEQ ID NO: 993
Celera Transcript: hCT2278076

Protein SEQ ID NO: 332
Public Protein Accession: XP_056681.4
Protein Name: similar to ribosomal protein L14; 60S ribosomal protein L14 [Homo sapiens]
Transcript SEQ ID NO: 994
Public Transcript Accession: XM_056681

Peptide SEQ ID NO: 1359 (53-62) Tissue GW215 , ratio = Singleton

======

Protein SEQ ID NO: 333
Public Protein Accession: P50914
Protein Name: 60S ribosomal protein L14 (CAG-ISL 7)
Transcript SEQ ID NO: 995
Public Transcript Accession: U16738

Peptide SEQ ID NO: 1359 (52-61) Tissue GW215 , ratio = Singleton

======

Protein SEQ ID NO: 334
Celera Protein: hCP1881997
Celera Gene: hCG2014475
Transcript SEQ ID NO: 996
Celera Transcript: hCT2306170

Peptide SEQ ID NO: 1359 (53-62) Tissue GW215 , ratio = Singleton

======

Protein SEQ ID NO: 335
Celera Protein: hCP1802460
Celera Gene: hCG1996846
Transcript SEQ ID NO: 997
Celera Transcript: hCT2278075

Peptide SEQ ID NO: 1359 (4-13) Tissue GW215 , ratio = Singleton

======

Protein SEQ ID NO: 336
Celera Protein: hCP1723902.2
Public Protein Accession: XP_210424.1
Celera Gene: hCG1782438.2
Transcript SEQ ID NO: 998
Celera Transcript: hCT1821349.2

Peptide SEQ ID NO: 1359 (53-62) Tissue GW215 , ratio = Singleton

======

Protein SEQ ID NO: 337
Celera Protein: hCP1791180
Celera Gene: hCG1990887
OMIM number: 116810
OMIM Information: CATHEPSIN B;CTSB
Transcript SEQ ID NO: 999
Celera Transcript: hCT2268496

Protein SEQ ID NO: 338
Celera Protein: hCP1791179
Celera Gene: hCG1990887
OMIM number: 116810
OMIM Information: CATHEPSIN B;CTSB
Transcript SEQ ID NO: 1000
Celera Transcript: hCT2268500

Protein SEQ ID NO: 339
Public Protein Accession: NP_001899.1
Protein Name: cathepsin B preproprotein; APP secretase; preprocathepsin B; cathepsin B1; amyloid precursor protein secretase [Homo sapiens]
Transcript SEQ ID NO: 1001
Public Transcript Accession: NM_001908

Protein SEQ ID NO: 340
Public Protein Accession: P07858
Protein Name: Cathepsin B precursor (EC 3.4.22.1) (Cathepsin B1) (APP secretase) (APPS)
Transcript SEQ ID NO: 1002
Public Transcript Accession: M14221

Protein SEQ ID NO: 341
Celera Protein: hCP1791183
Celera Gene: hCG1990887
OMIM number: 116810
OMIM Information: CATHEPSIN B;CTSB
Transcript SEQ ID NO: 1003
Celera Transcript: hCT2268491

Protein SEQ ID NO: 342
Celera Protein: hCP1791181
Celera Gene: hCG1990887
OMIM number: 116810
OMIM Information: CATHEPSIN B;CTSB
Transcript SEQ ID NO: 1004
Celera Transcript: hCT2268494

Protein SEQ ID NO: 343
Celera Protein: hCP1791175
Celera Gene: hCG1990887
OMIM number: 116810
OMIM Information: CATHEPSIN B;CTSB
Transcript SEQ ID NO: 1005
Celera Transcript: hCT2268497

Protein SEQ ID NO: 344
Celera Protein: hCP1791176
Celera Gene: hCG1990887
OMIM number: 116810
OMIM Information: CATHEPSIN B;CTSB
Transcript SEQ ID NO: 1006
Celera Transcript: hCT2268502

Protein SEQ ID NO: 345
Celera Protein: hCP1791177
Celera Gene: hCG1990887
OMIM number: 116810
OMIM Information: CATHEPSIN B;CTSB
Transcript SEQ ID NO: 1007

-continued

Celera Transcript: hCT2268493

Peptide SEQ ID NO: 1398 (314-330) Tissue NS216 , ratio = 6.3

======

Protein SEQ ID NO: 346
Celera Protein: hCP1864893
Celera Gene: hCG40242.3
OMIM number: 116940
OMIM Information: CELL DIVISION CYCLE 2, G1 TO S AND G2 TO M;CDC2
Transcript SEQ ID NO: 1008
Celera Transcript: hCT2321999

Protein SEQ ID NO: 347
Celera Protein: hCP1864892
Celera Gene: hCG40242.3
OMIM number: 116940
OMIM Information: CELL DIVISION CYCLE 2, G1 TO S AND G2 TO M;CDC2
Transcript SEQ ID NO: 1009
Celera Transcript: hCT2322001

Protein SEQ ID NO: 348
Celera Protein: hCP1762572
Celera Gene: hCG40242.3
OMIM number: 116940
OMIM Information: CELL DIVISION CYCLE 2, G1 TO S AND G2 TO M;CDC2
Transcript SEQ ID NO: 1010
Celera Transcript: hCT1957622.1

Protein SEQ ID NO: 349
Celera Protein: hCP1864888
Celera Gene: hCG40242.3
OMIM number: 116940
OMIM Information: CELL DIVISION CYCLE 2, G1 TO S AND G2 TO M;CDC2
Transcript SEQ ID NO: 1011
Celera Transcript: hCT2321996

Protein SEQ ID NO: 350
Celera Protein: hCP1864887
Celera Gene: hCG40242.3
OMIM number: 116940
OMIM Information: CELL DIVISION CYCLE 2, G1 TO S AND G2 TO M;CDC2
Transcript SEQ ID NO: 1012
Celera Transcript: hCT2321995

Peptide SEQ ID NO: 1440 (25-49) Tissue AS210 , ratio = Singleton

======

Protein SEQ ID NO: 351
Celera Protein: hCP1880347
Celera Gene: hCG25004.3
OMIM number: 601734
OMIM Information: SWI/SNF-RELATED, MATRIX-ASSOCIATED, ACTIN-DEPENDENT REGULATOR OF CHROMATIN, SUBFAMILY C, MEMBER 2;SMARCC2
Transcript SEQ ID NO: 1013
Celera Transcript: hCT2308914

Peptide SEQ ID NO: 1477 (630-640) Tissue AS210 , ratio = Singleton

======

Protein SEQ ID NO: 352
Public Protein Accession: NP_003065.2
Protein Name: SWI/SNF-related matrix-associated actin-dependent regulator of chromatin c1; mammalian chromatin remodeling complex BRG1-associated factor 155; chromatin remodeling complex BAF155 subunit; SWI/SNF complex 155 kDa subunit [Homo sapiens]
Transcript SEQ ID NO: 1014
Public Transcript Accession: NM_003074

Peptide SEQ ID NO: 1477 (652-662) Tissue AS210 , ratio = Singleton

======

Protein SEQ ID NO: 353
Celera Protein: hCP33226.5
Celera Gene: hCG14847.3
OMIM number: 601732
OMIM Information: SWI/SNF-RELATED, MATRIX-ASSOCIATED, ACTIN-DEPENDENT REGULATOR OF CHROMATIN, SUBFAMILY C, MEMBER 1;SMARCC1

-continued

Transcript SEQ ID NO: 1015
Celera Transcript: hCT5868.5

Peptide SEQ ID NO: 1477 (430-440) Tissue AS210 , ratio = Singleton

======

Protein SEQ ID NO: 354
Celera Protein: hCP1908054
Celera Gene: hCG14847.3
OMIM number: 601732
OMIM Information: SWI/SNF-RELATED, MATRIX-ASSOCIATED, ACTIN-DEPENDENT REGULATOR OF CHROMATIN, SUBFAMILY C, MEMBER 1;SMARCC1
Transcript SEQ ID NO: 1016
Celera Transcript: hCT2343348

Peptide SEQ ID NO: 1477 (314-324) Tissue AS210 , ratio = Singleton

======

Protein SEQ ID NO: 355
Celera Protein: hCP42006.3
Celera Gene: hCG25004.3
OMIM number: 601734
OMIM Information: SWI/SNF-RELATED, MATRIX-ASSOCIATED, ACTIN-DEPENDENT REGULATOR OF CHROMATIN, SUBFAMILY C, MEMBER 2;SMARCC2
Transcript SEQ ID NO: 1017
Celera Transcript: hCT16125.3

Peptide SEQ ID NO: 1477 (630-640) Tissue AS210 , ratio = Singleton

======

Protein SEQ ID NO: 356
Public Protein Accession: NP_620706.1
Protein Name: SWI/SNF-related matrix-associated actin-dependent regulator of chromatin c2 isoform b; mammalian chromatin remodeling complex BRG1-associated factor 170; chromatin remodeling complex BAF170 subunit; SWI3-like protein; SWI/SNF complex 170 kDa subunit [Homo sapiens]
Transcript SEQ ID NO: 1018
Public Transcript Accession: NM_139067

Protein SEQ ID NO: 357
Celera Protein: hCP1880348
Celera Gene: hCG25004.3
OMIM number: 601734
OMIM Information: SWI/SNF-RELATED, MATRIX-ASSOCIATED, ACTIN-DEPENDENT REGULATOR OF CHROMATIN, SUBFAMILY C, MEMBER 2;SMARCC2
Transcript SEQ ID NO: 1019
Celera Transcript: hCT2308912

Peptide SEQ ID NO: 1477 (661-671) Tissue AS210 , ratio = Singleton

======

Protein SEQ ID NO: 358
Celera Protein: hCP1796151
Celera Gene: hCG30330.2
Transcript SEQ ID NO: 1020
Celera Transcript: hCT2317294

Peptide SEQ ID NO: 1397 (77-92) Tissue AS210 , ratio = 10.9

======

Protein SEQ ID NO: 359
Public Protein Accession: P27105
Protein Name: Erythrocyte band 7 integral membrane protein (Stomatin) (Protein 7.2B)
Transcript SEQ ID NO: 1021
Public Transcript Accession: X60067

Peptide SEQ ID NO: 1397 (76-91) Tissue AS210 , ratio = 10.9

======

Protein SEQ ID NO: 360
Celera Protein: hCP44840
Celera Gene: hCG30330.2
Transcript SEQ ID NO: 1022
Celera Transcript: hCT21501.2

Peptide SEQ ID NO: 1397 (77-92) Tissue AS210 , ratio = 10.9

-continued

======

Protein SEQ ID NO: 361
Celera Protein: hCP1796147
Celera Gene: hCG30330.2
Transcript SEQ ID NO: 1023
Celera Transcript: hCT2317293

Peptide SEQ ID NO: 1397 (75-90) Tissue AS210 , ratio = 10.9

======

Protein SEQ ID NO: 362
Celera Protein: hCP1796148
Celera Gene: hCG30330.2
Transcript SEQ ID NO: 1024
Celera Transcript: hCT2317292

Peptide SEQ ID NO: 1397 (26-41) Tissue AS210 , ratio = 10.9

======

Protein SEQ ID NO: 363
Public Protein Accession: P30101
Protein Name: Protein disulfide isomerase A3 precursor (EC 5.3.4.1) (Disulfide isomerase ER-60) (ERp60) (58 kDa microsomal protein) (p58) (ERp57) (58 kDa glucose regulated protein)
Transcript SEQ ID NO: 1025
Public Transcript Accession: U42068

Protein SEQ ID NO: 364
Celera Protein: hCP37880.3
Celera Gene: hCG19430.3
Transcript SEQ ID NO: 1026
Celera Transcript: hCT10500.3

Protein SEQ ID NO: 365
Celera Protein: hCP47906.2
Celera Gene: hCG38001.3
OMIM number: 602046
OMIM Information: GLUCOSE-REGULATED PROTEIN, 58-KD;GRP58
Transcript SEQ ID NO: 1027
Celera Transcript: hCT29238.3

Peptide SEQ ID NO: 1424 (233-251) Tissue AS210 , ratio = Singleton

======

Protein SEQ ID NO: 366
Celera Protein: hCP1805982
Celera Gene: hCG1999081
Transcript SEQ ID NO: 1028
Celera Transcript: hCT2281675

Peptide SEQ ID NO: 1395 (22-41) Tissue AS210 , ratio = Singleton

======

Protein SEQ ID NO: 367
Celera Protein: hCP1792760
Celera Gene: hCG30697.2
Transcript SEQ ID NO: 1029
Celera Transcript: hCT2287862

Peptide SEQ ID NO: 1367 (757-773) Tissue AS210 , ratio = Singleton
Peptide SEQ ID NO: 1419 (427-436) Tissue AS210 , ratio = 5.7
Peptide SEQ ID NO: 1414 (733-745) Tissue AS210 , ratio = Singleton
Peptide SEQ ID NO: 1384 (636-653) Tissue AS210 , ratio = Singleton
Peptide SEQ ID NO: 1486 (688-701) Tissue AS210 , ratio = Singleton
Peptide SEQ ID NO: 1452 (336-345) Tissue AS210 , ratio = >10.0

======

Protein SEQ ID NO: 368
Celera Protein: hCP1766211.1
Celera Gene: hCG30697.2
Transcript SEQ ID NO: 1030
Celera Transcript: hCT1952714.1

Peptide SEQ ID NO: 1367 (55-71) Tissue AS210 , ratio = Singleton

Peptide SEQ ID NO: 1414 (31-43) Tissue AS210 , ratio = Singleton

======

Protein SEQ ID NO: 369
Celera Protein: hCP1792761
Celera Gene: hCG30697.2
Transcript SEQ ID NO: 1031
Celera Transcript: hCT2287858

Peptide SEQ ID NO: 1367 (772-788) Tissue AS210 , ratio = Singleton
Peptide SEQ ID NO: 1419 (442-451) Tissue AS210 , ratio = 5.7
Peptide SEQ ID NO: 1414 (748-760) Tissue AS210 , ratio = Singleton
Peptide SEQ ID NO: 1384 (651-668) Tissue AS210 , ratio = Singleton
Peptide SEQ ID NO: 1486 (703-716) Tissue AS210 , ratio = Singleton
Peptide SEQ ID NO: 1452 (351-360) Tissue AS210 , ratio = >10.0

======

Protein SEQ ID NO: 370
Celera Protein: hCP44926.2
Celera Gene: hCG30697.2
Transcript SEQ ID NO: 1032
Celera Transcript: hCT21872.2

Protein SEQ ID NO: 371
Public Protein Accession: P05164
Protein Name: Myeloperoxidase
Transcript SEQ ID NO: 1033
Public Transcript Accession: S56200

Peptide SEQ ID NO: 1367 (725-741) Tissue AS210 , ratio = Singleton
Peptide SEQ ID NO: 1419 (395-404) Tissue AS210 , ratio = 5.7
Peptide SEQ ID NO: 1414 (701-713) Tissue AS210 , ratio = Singleton
Peptide SEQ ID NO: 1384 (604-621) Tissue AS210 , ratio = Singleton
Peptide SEQ ID NO: 1486 (656-669) Tissue AS210 , ratio = Singleton
Peptide SEQ ID NO: 1452 (304-313) Tissue AS210 , ratio = >10.0

======

Protein SEQ ID NO: 372
Celera Protein: hCP1767303.1
Celera Gene: hCG37798.3
Transcript SEQ ID NO: 1034
Celera Transcript: hCT1951559.1

Peptide SEQ ID NO: 1499 (2-15) Tissue AS210 , ratio = 5

======

Protein SEQ ID NO: 373
Celera Protein: hCP47741.2
Celera Gene: hCG37798.3
Transcript SEQ ID NO: 1035
Celera Transcript: hCT29032.3

Protein SEQ ID NO: 374
Public Protein Accession: P05026
Protein Name: Sodium/potassium-transporting ATPase beta-1 chain (Sodium/potassium- dependent ATPase beta-1 subunit)
Transcript SEQ ID NO: 1036
Public Transcript Accession: BC000006

Peptide SEQ ID NO: 1499 (203-216) Tissue AS210 , ratio = 5

======

Protein SEQ ID NO: 375
Celera Protein: hCP44839.3
Celera Gene: hCG27454.4
OMIM number: 137350
OMIM Information: GELSOLIN;GSN
Transcript SEQ ID NO: 1037
Celera Transcript: hCT18594.4

Protein SEQ ID NO: 376
Public Protein Accession: NP_937895.1
Protein Name: gelsolin isoform b; Gelsolin [Homo sapiens]
Transcript SEQ ID NO: 1038
Public Transcript Accession: NM_198252

-continued

Peptide SEQ ID NO: 1462 (276-286) Tissue GW215 , ratio = Singleton

======

Protein SEQ ID NO: 377
Celera Protein: hCP1752434.2
Celera Gene: hCG27454.4
OMIM number: 137350
OMIM Information: GELSOLIN;GSN
Transcript SEQ ID NO: 1039
Celera Transcript: hCT1951162.2

Peptide SEQ ID NO: 1462 (287-297) Tissue GW215 , ratio = Singleton

======

Protein SEQ ID NO: 378
Celera Protein: hCP1766686.1
Celera Gene: hCG27454.4
OMIM number: 137350
OMIM Information: GELSOLIN;GSN
Transcript SEQ ID NO: 1040
Celera Transcript: hCT1951161.2

Protein SEQ ID NO: 379
Public Protein Accession: P06396
Protein Name: Human full-length polypeptide sequence #168
Transcript SEQ ID NO: 1041
Public Transcript Accession: BC026033

Peptide SEQ ID NO: 1462 (327-337) Tissue GW215 , ratio = Singleton

======

Protein SEQ ID NO: 380
Celera Protein: hCP1798074
Celera Gene: hCG41537.3
OMIM number: 602362
OMIM Information: GTPase-ACTIVATING PROTEIN, RAN, 1;RANGAP1
Transcript SEQ ID NO: 1042
Celera Transcript: hCT2300933

Peptide SEQ ID NO: 1378 (296-306) Tissue AS210 , ratio = Singleton

======

Protein SEQ ID NO: 381
Celera Protein: hCP1751630
Celera Gene: hCG41537.3
OMIM number: 602362
OMIM Information: GTPase-ACTIVATING PROTEIN, RAN, 1;RANGAP1
Transcript SEQ ID NO: 1043
Celera Transcript: hCT1951580.1

Peptide SEQ ID NO: 1378 (351-361) Tissue AS210 , ratio = Singleton

======

Protein SEQ ID NO: 382
Celera Protein: hCP1798073
Celera Gene: hCG41537.3
OMIM number: 602362
OMIM Information: GTPase-ACTIVATING PROTEIN, RAN, 1;RANGAP1
Transcript SEQ ID NO: 1044
Celera Transcript: hCT2300931

Protein SEQ ID NO: 383
Celera Protein: hCP51425.2
Celera Gene: hCG41537.3
OMIM number: 602362
OMIM Information: GTPase-ACTIVATING PROTEIN, RAN, 1;RANGAP1
Transcript SEQ ID NO: 1045
Celera Transcript: hCT32809.3

Protein SEQ ID NO: 384
Public Protein Accession: P46060
Protein Name: Ran GTPase-activating protein 1
Transcript SEQ ID NO: 1046
Public Transcript Accession: X82260

-continued

Protein SEQ ID NO: 385
Celera Protein: hCP1798070
Celera Gene: hCG41537.3
OMIM number: 602362
OMIM Information: GTPase-ACTIVATING PROTEIN, RAN, 1;RANGAP1
Transcript SEQ ID NO: 1047
Celera Transcript: hCT2300929

Peptide SEQ ID NO: 1378 (296-306) Tissue AS210 , ratio = Singleton

======

Protein SEQ ID NO: 386
Celera Protein: hCP1798076
Celera Gene: hCG41537.3
OMIM number: 602362
OMIM Information: GTPase-ACTIVATING PROTEIN, RAN, 1;RANGAP1
Transcript SEQ ID NO: 1048
Celera Transcript: hCT2300930

Peptide SEQ ID NO: 1378 (351-361) Tissue AS210 , ratio = Singleton

======

Protein SEQ ID NO: 387
Public Protein Accession: Q9H1Z3
Protein Name: Lactotransferrin precursor (Lactoferrin) [Contains: Lactoferroxin A Lactoferroxin B; Lactoferroxin C]
Transcript SEQ ID NO: 1049
Public Transcript Accession: U07643

Protein SEQ ID NO: 388
Celera Protein: hCP35766.2
Celera Gene: hCG15323.2
OMIM number: 150210
OMIM Information: LACTOTRANSFERRIN;LTF
Transcript SEQ ID NO: 1050
Celera Transcript: hCT6345.2

Protein SEQ ID NO: 389
Public Protein Accession: NP_002334.1
Protein Name: Chronic hepatitis treatment related protein SEQ ID NO: 9
Transcript SEQ ID NO: 1051
Public Transcript Accession: NM_002343

Peptide SEQ ID NO: 1364 (696-709) Tissue AS210 , ratio = Singleton
Peptide SEQ ID NO: 1458 (477-484) Tissue AS210 , ratio = Singleton

======

Protein SEQ ID NO: 390
Celera Protein: hCP1880626
Celera Gene: hCG2016481
Transcript SEQ ID NO: 1052
Celera Transcript: hCT2309382

Peptide SEQ ID NO: 1389 (47-71) Tissue AS210 , ratio = Singleton

======

Protein SEQ ID NO: 391
Celera Protein: hCP1794544
Celera Gene: hCG2006386
Transcript SEQ ID NO: 1053
Celera Transcript: hCT2293692

Protein SEQ ID NO: 392
Celera Protein: hCP1794545
Celera Gene: hCG2006386
Transcript SEQ ID NO: 1054
Celera Transcript: hCT2293691

Peptide SEQ ID NO: 1492 (32-47) Tissue AS210 , ratio = Singleton

======

Protein SEQ ID NO: 393
Celera Protein: hCP1796735
Celera Gene: hCG1811085.1
OMIM number: 600899
OMIM Information: PROTEIN KINASE, DNA-ACTIVATED, CATALYTIC SUBUNIT;PRKDC -continued Transcript SEQ ID NO: 1055
Celera Transcript: hCT2257127

Protein SEQ ID NO: 394
Public Protein Accession: NP_008835.5 P78527
Protein Name: Human expressed protein tag (EPT) #573
Transcript SEQ ID NO: 1056
Public Transcript Accession: NM_006904

Protein SEQ ID NO: 395
Celera Protein: hCP1796736
Celera Gene: hCG1811085.1
OMIM number: 600899
OMIM Information: PROTEIN KINASE, DNA-ACTIVATED, CATALYTIC SUBUNIT;PRKDC
Transcript SEQ ID NO: 1057
Celera Transcript: hCT2257125

Protein SEQ ID NO: 396
Celera Protein: hCP1858706
Celera Gene: hCG1983728
Transcript SEQ ID NO: 1058
Celera Transcript: hCT2257641

Protein SEQ ID NO: 397
Celera Protein: hCP1765981.1
Celera Gene: hCG1811085.1
OMIM number: 600899
OMIM Information: PROTEIN KINASE, DNA-ACTIVATED, CATALYTIC SUBUNIT;PRKDC
Transcript SEQ ID NO: 1059
Celera Transcript: hCT1951438.1

Peptide SEQ ID NO: 1388 (1735-1743) Tissue GW215 , ratio = Singleton
Peptide SEQ ID NO: 1356 (122-132) Tissue AS210 , ratio = Singleton
Peptide SEQ ID NO: 1370 (790-800) Tissue GW215 , ratio = Singleton
Peptide SEQ ID NO: 1439 (216-224) Tissue AS210 , ratio = Singleton
Peptide SEQ ID NO: 1467 (1119-1135) Tissue GW215 , ratio = Singleton

======

Protein SEQ ID NO: 398
Celera Protein: hCP1861972
Celera Gene: hCG19377.3
OMIM number: 604734
OMIM Information: WD REPEAT-CONTAINING PROTEIN 1;WDR1
Transcript SEQ ID NO: 1060
Celera Transcript: hCT2326080

Protein SEQ ID NO: 399
Celera Protein: hCP38517.2
Celera Gene: hCG19377.3
OMIM number: 604734
OMIM Information: WD REPEAT-CONTAINING PROTEIN 1;WDR1
Transcript SEQ ID NO: 1061
Celera Transcript: hCT10446.3

Protein SEQ ID NO: 400
Celera Protein: hCP1861974
Celera Gene: hCG19377.3
OMIM number: 604734
OMIM Information: WD REPEAT-CONTAINING PROTEIN 1;WDR1
Transcript SEQ ID NO: 1062
Celera Transcript: hCT2326081

Protein SEQ ID NO: 401
Celera Protein: hCP1861973
Celera Gene: hCG19377.3
OMIM number: 604734
OMIM Information: WD REPEAT-CONTAINING PROTEIN 1;WDR1
Transcript SEQ ID NO: 1063
Celera Transcript: hCT2326083

Protein SEQ ID NO: 402
Public Protein Accession: O75083
Protein Name: WD-repeat protein 1 (Actin interacting protein 1) (AIP1) (NORI-1)
Transcript SEQ ID NO: 1064
Public Transcript Accession: AB010427

Peptide SEQ ID NO: 1391 (190-195) Tissue AS210 , ratio = Singleton

======

-continued

Protein SEQ ID NO: 403
Celera Protein: hCP1768777
Celera Gene: hCG40760.3
Transcript SEQ ID NO: 1065
Celera Transcript: hCT1816107.1

Peptide SEQ ID NO: 1390 (103-121) Tissue GW215 , ratio = Singleton

======

Protein SEQ ID NO: 404
Celera Protein: hCP1884631
Celera Gene: hCG40760.3
OMIM number: 603138
OMIM Information: CULLIN 4B;CUL4B
Transcript SEQ ID NO: 1066
Celera Transcript: hCT2253759

Peptide SEQ ID NO: 1390 (60-78) Tissue GW215 , ratio = Singleton

======

Protein SEQ ID NO: 405
Celera Protein: hCP1765470.1
Celera Gene: hCG40760.3
Transcript SEQ ID NO: 1067
Celera Transcript: hCT1958768.1

Protein SEQ ID NO: 406
Public Protein Accession: NP_054779.1
Protein Name: Multiple COPIES in A T-cell MALIGNANCIES (MCT-1 protein)
Transcript SEQ ID NO: 1068
Public Transcript Accession: NM_014060

Peptide SEQ ID NO: 1390 (103-121) Tissue GW215 , ratio = Singleton

======

Protein SEQ ID NO: 407
Celera Protein: hCP1891797
Celera Gene: hCG1642477.2
OMIM number: 114890
OMIM Information: CARCINOEMBRYONIC ANTIGEN-RELATED CELL ADHESION MOLECULE 5;CEACAM5
Transcript SEQ ID NO: 1069
Celera Transcript: hCT2275995

Protein SEQ ID NO: 408
Public Protein Accession: P06731
Protein Name: Human CEA protein SEQ ID NO:592
Transcript SEQ ID NO: 1070
Public Transcript Accession: M29540

Protein SEQ ID NO: 409
Celera Protein: hCP1605863.2
Celera Gene: hCG1642477.2
OMIM number: 114890
OMIM Information: CARCINOEMBRYONIC ANTIGEN-RELATED CELL ADHESION MOLECULE 5;CEACAM5
Transcript SEQ ID NO: 1071
Celera Transcript: hCT1642604.2

Peptide SEQ ID NO: 1352 (214-223) Tissue AS210 , ratio = 14.5
Peptide SEQ ID NO: 1352 (214-223) Tissue GW215 , ratio = 2.2

======

Protein SEQ ID NO: 410
Celera Protein: hCP1887428
Celera Gene: hCG18289.3
Transcript SEQ ID NO: 1072
Celera Transcript: hCT2306462

Protein SEQ ID NO: 411
Celera Protein: hCP1887432
Celera Gene: hCG18289.3
Transcript SEQ ID NO: 1073
Celera Transcript: hCT2306463

Protein SEQ ID NO: 412
Public Protein Accession: Q02218

-continued

Protein Name: 2-oxoglutarate dehydrogenase E1 component, mitochondrial precursor (EC 1.2.4.2) (Alpha-ketoglutarate dehydrogenase)
Transcript SEQ ID NO: 1074
Public Transcript Accession: D10523

Protein SEQ ID NO: 413
Celera Protein: hCP1887429
Celera Gene: hCG18289.3
Transcript SEQ ID NO: 1075
Celera Transcript: hCT2306459

Protein SEQ ID NO: 414
Celera Protein: hCP36447.3
Celera Gene: hCG18289.3
Transcript SEQ ID NO: 1076
Celera Transcript: hCT9347.3

Peptide SEQ ID NO: 1387 (797-812) Tissue GW215 , ratio = Singleton

======

Protein SEQ ID NO: 415
Celera Protein: hCP1724291.1
Celera Gene: hCG1747191.2
OMIM number: 602389
OMIM Information: Tu TRANSLATION ELONGATION FACTOR, MITOCHONDRIAL;TUFM
Transcript SEQ ID NO: 1077
Celera Transcript: hCT1785516.1

Protein SEQ ID NO: 416
Celera Protein: hCP1761522
Celera Gene: hCG1747191.2
OMIM number: 602389
OMIM Information: Tu TRANSLATION ELONGATION FACTOR, MITOCHONDRIAL;TUFM
Transcript SEQ ID NO: 1078
Celera Transcript: hCT1957071.1

Peptide SEQ ID NO: 1425 (288-299) Tissue GW215 , ratio = Singleton

======

Protein SEQ ID NO: 417
Public Protein Accession: P49411
Protein Name: Elongation factor Tu, mitochondrial precursor (EF-Tu) (P43)

Peptide SEQ ID NO: 1425 (285-296) Tissue GW215 , ratio = Singleton

======

Protein SEQ ID NO: 418
Public Protein Accession: NP_003312.3
Protein Name: Tu translation elongation factor, mitochondrial [Homo sapiens]
Transcript SEQ ID NO: 1079
Public Transcript Accession: NM_003321

Peptide SEQ ID NO: 1425 (288-299) Tissue GW215 , ratio = Singleton

======

Protein SEQ ID NO: 419
Celera Protein: hCP1897762
Celera Gene: hCG2023646
OMIM number: 601969
OMIM Information: DELETED IN MALIGNANT BRAIN TUMORS 1;DMBT1
Transcript SEQ ID NO: 1080
Celera Transcript: hCT2344988

Peptide SEQ ID NO: 1399 (120-140) Tissue GW215 , ratio = 8.3
Peptide SEQ ID NO: 1455 (522-536) Tissue GW215 , ratio = Singleton

======

Protein SEQ ID NO: 420
Celera Protein: hCP1910273
Celera Gene: hCG2040006
OMIM number: 601969
OMIM Information: DELETED IN MALIGNANT BRAIN TUMORS 1;DMBT1
Transcript SEQ ID NO: 1081
Celera Transcript: hCT2344987

Peptide SEQ ID NO: 1399 (120-140) Tissue GW215 , ratio = 8.3

-continued

Peptide SEQ ID NO: 1455 (533-547) Tissue GW215 , ratio = Singleton

======

Protein SEQ ID NO: 421
Public Protein Accession: NP_060049.1
Protein Name: DMBT1/8kb.1 protein
Transcript SEQ ID NO: 1082
Public Transcript Accession: NM_017579

Peptide SEQ ID NO: 1399 (120-140) Tissue GW215 , ratio = 8.3
Peptide SEQ ID NO: 1455 (1022-1036) Tissue GW215 , ratio = Singleton

======

Protein SEQ ID NO: 422
Celera Protein: hCP1897761
Celera Gene: hCG2023646
OMIM number: 601969
OMIM Information: DELETED IN MALIGNANT BRAIN TUMORS 1;DMBT1
Transcript SEQ ID NO: 1083
Celera Transcript: hCT2344989

Peptide SEQ ID NO: 1399 (120-140) Tissue GW215 , ratio = 8.3
Peptide SEQ ID NO: 1455 (533-547) Tissue GW215 , ratio = Singleton

======

Protein SEQ ID NO: 423
Public Protein Accession: NP_015568.1
Protein Name: Gp-340 variant protein
Transcript SEQ ID NO: 1084
Public Transcript Accession: NM_007329

Peptide SEQ ID NO: 1399 (120-140) Tissue GW215 , ratio = 8.3
Peptide SEQ ID NO: 1455 (641-655) Tissue GW215 , ratio = Singleton

======

Protein SEQ ID NO: 424
Celera Protein: hCP1897763
Celera Gene: hCG2023646
OMIM number: 601969
OMIM Information: DELETED IN MALIGNANT BRAIN TUMORS 1;DMBT1
Transcript SEQ ID NO: 1085
Celera Transcript: hCT2344986

Peptide SEQ ID NO: 1399 (120-140) Tissue GW215 , ratio = 8.3
Peptide SEQ ID NO: 1455 (533-547) Tissue GW215 , ratio = Singleton

======

Protein SEQ ID NO: 425
Public Protein Accession: XP_232342.2
Protein Name: similar to macrophage hemoglobin scavenger receptor CD163 precursor [Rattus norvegicus]
Transcript SEQ ID NO: 1086
Public Transcript Accession: XM_232342

Peptide SEQ ID NO: 1402 (399-410) Tissue NS216 , ratio = Singleton

======

Protein SEQ ID NO: 426
Public Protein Accession: P13758
Protein Name: HLA class II histocompatibility antigen, DR-1 beta chain precursor
Transcript SEQ ID NO: 1087
Public Transcript Accession: X03069

Peptide SEQ ID NO: 1333 (101-108) Tissue GW215 , ratio = 6.8

======

Protein SEQ ID NO: 427
Public Protein Accession: P01911
Protein Name: HLA class II histocompatibility antigen, DW2.2/DR2.2 beta chain (Fragment)

Peptide SEQ ID NO: 1333 (72-79) Tissue GW215 , ratio = 6.8

======

Protein SEQ ID NO: 428
Public Protein Accession: P13760
Protein Name: HLA class II histocompatibility antigen, DR-4 beta chain precursor (DRB1*0401)

Protein SEQ ID NO: 429
Celera Protein: hCP1741174
Celera Gene: hCG1791131.2
OMIM number: 142857
OMIM Information: MAJOR HISTOCOMPATIBILITY COMPLEX, CLASS II, DR BETA-1;HLA-DRB1
Transcript SEQ ID NO: 1088
Celera Transcript: hCT1830391.2

Protein SEQ ID NO: 430
Public Protein Accession: P13759
Protein Name: HLA class II histocompatibility antigen, DR-1 (DW14) beta chain precursor Protein SEQ ID NO: 431
Public Protein Accession: P01914
Protein Name: HLA class II histocompatibility antigen, DR-1 beta chain precursor (Clone P2-beta-4)
Transcript SEQ ID NO: 1089
Public Transcript Accession: X00700

Protein SEQ ID NO: 432
Public Protein Accession: P20039
Protein Name: HLA class II histocompatibility antigen, DR-5 beta chain precursor
Transcript SEQ ID NO: 1090
Public Transcript Accession: M11867

Peptide SEQ ID NO: 1333 (101-108) Tissue GW215 , ratio = 6.8

======

Protein SEQ ID NO: 433
Celera Protein: hCP1855362
Celera Gene: hCG1992647
OMIM number: 604776
OMIM Information: MAJOR HISTOCOMPATIBILITY COMPLEX, CLASS II, DR BETA-5;HLA-DRB5
Transcript SEQ ID NO: 1091
Celera Transcript: hCT2271363

Peptide SEQ ID NO: 1333 (69-76) Tissue GW215 , ratio = 6.8

======

Protein SEQ ID NO: 434
Public Protein Accession: Q30167
Protein Name: HLA-DRB2 protein precursor
Transcript SEQ ID NO: 1092
Public Transcript Accession: M20138

Protein SEQ ID NO: 435
Public Protein Accession: NP_002116.2
Protein Name: HLA-DRB1 protein precursor (Similar to major histocompatibility complex, class II, DR beta 1)
Transcript SEQ ID NO: 1093
Public Transcript Accession: NM_002125

Peptide SEQ ID NO: 1333 (101-108) Tissue GW215 , ratio = 6.8

======

Protein SEQ ID NO: 436
Celera Protein: hCP1855363
Celera Gene: hCG1992647
OMIM number: 604776
OMIM Information: MAJOR HISTOCOMPATIBILITY COMPLEX, CLASS II, DR BETA-5;HLA-DRB5
Transcript SEQ ID NO: 1094
Celera Transcript: hCT2271364

Peptide SEQ ID NO: 1333 (69-76) Tissue GW215 , ratio = 6.8

======

Protein SEQ ID NO: 437
Public Protein Accession: P35221
Protein Name: Alpha-1 catenin (Cadherin-associated protein) (Alpha E-catenin)
Transcript SEQ ID NO: 1095
Public Transcript Accession: D13866

Peptide SEQ ID NO: 1446 (451-477) Tissue AS210 , ratio = Singleton

-continued

======

Protein SEQ ID NO: 438
Celera Protein: hCP1894804.1
Celera Gene: hCG1782385.3
OMIM number: 116805
OMIM Information: CATENIN, ALPHA-1;CTNNA1
Transcript SEQ ID NO: 1096
Celera Transcript: hCT2253785.1

Peptide SEQ ID NO: 1446 (81-107) Tissue AS210 , ratio = Singleton

======

Protein SEQ ID NO: 439
Celera Protein: hCP1704204.2
Celera Gene: hCG1782385.3
OMIM number: 116805
OMIM Information: CATENIN, ALPHA-1;CTNNA1
Transcript SEQ ID NO: 1097
Celera Transcript: hCT1821291.3

Protein SEQ ID NO: 440
Celera Protein: hCP1894801.1
Celera Gene: hCG1782385.3
OMIM number: 116805
OMIM Information: CATENIN, ALPHA-1;CTNNA1
Transcript SEQ ID NO: 1098
Celera Transcript: hCT2253782.1

Peptide SEQ ID NO: 1446 (451-477) Tissue AS210 , ratio = Singleton

======

Protein SEQ ID NO: 441
Public Protein Accession: P35659
Protein Name: Human translocation (6; 9) (p23; q34) protein
Transcript SEQ ID NO: 1099
Public Transcript Accession: X64229

Protein SEQ ID NO: 442
Celera Protein: hCP1790503
Celera Gene: hCG36749.3
OMIM number: 125264
OMIM Information: DEK ONCOGENE;DEK
Transcript SEQ ID NO: 1100
Celera Transcript: hCT2251472

Protein SEQ ID NO: 443
Celera Protein: hCP47305.1
Celera Gene: hCG36749.3
OMIM number: 125264
OMIM Information: DEK ONCOGENE;DEK
Transcript SEQ ID NO: 1101
Celera Transcript: hCT27978.2

Protein SEQ ID NO: 444
Celera Protein: hCP1790234
Celera Gene: hCG36749.3
OMIM number: 125264
OMIM Information: DEK ONCOGENE;DEK
Transcript SEQ ID NO: 1102
Celera Transcript: hCT2251473

Peptide SEQ ID NO: 1465 (158-167) Tissue AS210 , ratio = Singleton

======

Protein SEQ ID NO: 445
Celera Protein: hCP1766211.1
Celera Gene: hCG30697.2
Transcript SEQ ID NO: 1103
Celera Transcript: hCT1952714.1

Peptide SEQ ID NO: 1419 (395-404) Tissue AS210 , ratio = 5.7
Peptide SEQ ID NO: 1384 (604-621) Tissue AS210 , ratio = Singleton
Peptide SEQ ID NO: 1486 (656-669) Tissue AS210 , ratio = Singleton
Peptide SEQ ID NO: 1452 (304-313) Tissue AS210 , ratio = >10.0

======

Protein SEQ ID NO: 446
Celera Protein: hCP44928.1
Celera Gene: hCG30699.2
OMIM number: 131399
OMIM Information: EOSINOPHIL PEROXIDASE;EPX
Transcript SEQ ID NO: 1104
Celera Transcript: hCT21873.3

Protein SEQ ID NO: 447
Public Protein Accession: P11678
Protein Name: Human polypeptide SEQ ID NO 1568

Protein SEQ ID NO: 448
Celera Protein: hCP1792741
Celera Gene: hCG30699.2
OMIM number: 131399
OMIM Information: EOSINOPHIL PEROXIDASE;EPX
Transcript SEQ ID NO: 1105
Celera Transcript: hCT2288280

Protein SEQ ID NO: 449
Celera Protein: hCP1781334.1
Celera Gene: hCG30699.2
OMIM number: 131399
OMIM Information: EOSINOPHIL PEROXIDASE;EPX
Transcript SEQ ID NO: 1106
Celera Transcript: hCT1965693.1

Peptide SEQ ID NO: 1419 (367-376) Tissue AS210 , ratio = 5.7

======

Protein SEQ ID NO: 450
Celera Protein: hCP1858953
Celera Gene: hCG21109.3
OMIM number: 602950
OMIM Information: HETEROGENEOUS NUCLEAR RIBONUCLEOPROTEIN METHYLTRANSFERASE 1-LIKE 2;HRMT1L2
Transcript SEQ ID NO: 1107
Celera Transcript: hCT2280007

Peptide SEQ ID NO: 1482 (145-159) Tissue GW215 , ratio = Singleton
Peptide SEQ ID NO: 1488 (95-109) Tissue GW215 , ratio = Singleton

======

Protein SEQ ID NO: 451
Celera Protein: hCP1862445
Celera Gene: hCG40703.2
Transcript SEQ ID NO: 1108
Celera Transcript: hCT2325913

Peptide SEQ ID NO: 1469 (290-310) Tissue AS210 , ratio = Singleton
Peptide SEQ ID NO: 1432 (504-512) Tissue AS210 , ratio = Singleton
Peptide SEQ ID NO: 1443 (544-555) Tissue AS210 , ratio = Singleton

======

Protein SEQ ID NO: 452
Celera Protein: hCP1862443
Celera Gene: hCG40703.2
Transcript SEQ ID NO: 1109
Celera Transcript: hCT2325915

Protein SEQ ID NO: 453
Celera Protein: hCP50447.2
Celera Gene: hCG40703.2
Transcript SEQ ID NO: 1110
Celera Transcript: hCT31964.3

Protein SEQ ID NO: 454
Public Protein Accession: NP_006008.1 O43490
Protein Name: Human haematopoietic stem and progenitor cell antigen AC133
Transcript SEQ ID NO: 1111
Public Transcript Accession: NM_006017

Peptide SEQ ID NO: 1469 (299-319) Tissue AS210 , ratio = Singleton
Peptide SEQ ID NO: 1432 (513-521) Tissue AS210 , ratio = Singleton
Peptide SEQ ID NO: 1443 (553-564) Tissue AS210 , ratio = Singleton

======

Protein SEQ ID NO: 455
Celera Protein: hCP1761482.1
Celera Gene: hCG17889.3
OMIM number: 116790
OMIM Information: CATECHOL-O-METHYLTRANSFERASE;COMT
Transcript SEQ ID NO: 1112
Celera Transcript: hCT1955643.1

Peptide SEQ ID NO: 1416 (96-123) Tissue NS216 , ratio = 4.1

======

Protein SEQ ID NO: 456
Celera Protein: hCP33846.2
Celera Gene: hCG17889.3
OMIM number: 116790
OMIM Information: CATECHOL-O-METHYLTRANSFERASE;COMT
Transcript SEQ ID NO: 1113
Celera Transcript: hCT8943.3

Protein SEQ ID NO: 457
Public Protein Accession: NP_000745.1 P21964
Protein Name: Catechol O-methyltransferase, membrane-bound form (EC 2.1.1.6) (MB-COMT) [Contains: Catechol O-methyltransferase, soluble form (S-COMT)]
Transcript SEQ ID NO: 1114
Public Transcript Accession: NM_000754

Protein SEQ ID NO: 458
Celera Protein: hCP1761510
Celera Gene: hCG17889.3
OMIM number: 116790
OMIM Information: CATECHOL-O-METHYLTRANSFERASE;COMT
Transcript SEQ ID NO: 1115
Celera Transcript: hCT1955645.1

Peptide SEQ ID NO: 1416 (58-85) Tissue NS216 , ratio = 4.1

======

Protein SEQ ID NO: 459
Public Protein Accession: NP_009294.1
Protein Name: catechol-O-methyltransferase isoform S-COMT [Homo sapiens]
Transcript SEQ ID NO: 1116
Public Transcript Accession: NM_007310

Peptide SEQ ID NO: 1416 (8-35) Tissue NS216 , ratio = 4.1

======

Protein SEQ ID NO: 460
Celera Protein: hCP48834.2
Celera Gene: hCG38703.3
Transcript SEQ ID NO: 1117
Celera Transcript: hCT29947.3

Peptide SEQ ID NO: 1335 (1528-1534) Tissue GW215 , ratio = Singleton

======

Protein SEQ ID NO: 461
Celera Protein: hCP48303.3
Celera Gene: hCG38402.3
OMIM number: 107820
OMIM Information: ARGINYL-tRNA SYNTHETASE;RARS
Transcript SEQ ID NO: 1118
Celera Transcript: hCT29644.3

Protein SEQ ID NO: 462
Public Protein Accession: NP_002878.2 P54136
Protein Name: Arginyl-tRNA synthetase (EC 6.1.1.19) (Arginine--tRNA ligase) (ArgRS)
Transcript SEQ ID NO: 1119
Public Transcript Accession: NM_002887

Peptide SEQ ID NO: 1445 (634-646) Tissue AS210 , ratio = Singleton

======

Protein SEQ ID NO: 463

-continued

Celera Protein: hCP49397.2
Celera Gene: hCG38082.3
Transcript SEQ ID NO: 1120
Celera Transcript: hCT29319.3

Protein SEQ ID NO: 464
Celera Protein: hCP1865336
Celera Gene: hCG38082.3
Transcript SEQ ID NO: 1121
Celera Transcript: hCT2254558

Protein SEQ ID NO: 465
Celera Protein: hCP1865334
Celera Gene: hCG38082.3
Transcript SEQ ID NO: 1122
Celera Transcript: hCT2254559

Protein SEQ ID NO: 466
Public Protein Accession: O76024
Protein Name: Human wm1 protein
Transcript SEQ ID NO: 1123
Public Transcript Accession: Y18064

Peptide SEQ ID NO: 1478 (685-696) Tissue AS210 , ratio = Singleton

======

Protein SEQ ID NO: 467
Celera Protein: hCP1853982
Celera Gene: hCG2006678
Transcript SEQ ID NO: 1124
Celera Transcript: hCT2294062

Protein SEQ ID NO: 468
Celera Protein: hCP1853984
Celera Gene: hCG2006678
Transcript SEQ ID NO: 1125
Celera Transcript: hCT2294063

Protein SEQ ID NO: 469
Public Protein Accession: NP_005794.1 O75955
Protein Name: Flotillin-1
Transcript SEQ ID NO: 1126
Public Transcript Accession: NM_005803

Protein SEQ ID NO: 470
Celera Protein: hCP1853983
Celera Gene: hCG2006678
Transcript SEQ ID NO: 1127
Celera Transcript: hCT2294061

Peptide SEQ ID NO: 1484 (28-39) Tissue AS210 , ratio = Singleton

======

Protein SEQ ID NO: 471
Public Protein Accession: NP_057731.1
Protein Name: Mesenchymal stem cell protein DSCD75
Transcript SEQ ID NO: 1128
Public Transcript Accession: NM_016647

Peptide SEQ ID NO: 1354 (84-91) Tissue AS210 , ratio = 2.5
Peptide SEQ ID NO: 1368 (141-149) Tissue AS210 , ratio = 4.1

======

Protein SEQ ID NO: 472
Celera Protein: hCP49121.3
Celera Gene: hCG39308.3
Transcript SEQ ID NO: 1129
Celera Transcript: hCT30559.3

Peptide SEQ ID NO: 1354 (106-113) Tissue AS210 , ratio = 2.5
Peptide SEQ ID NO: 1368 (163-171) Tissue AS210 , ratio = 4.1

======

Protein SEQ ID NO: 473
Celera Protein: hCP42160.2
Celera Gene: hCG25213.3

-continued

OMIM number: 154540
OMIM Information: MANNOSE 6-PHOSPHATE RECEPTOR, CATION-DEPENDENT;M6PR
Transcript SEQ ID NO: 1130
Celera Transcript: hCT16338.3

Peptide SEQ ID NO: 1346 (138-146) Tissue AS210 , ratio = 5.6

======

Protein SEQ ID NO: 474
Celera Protein: hCP1774868.1
Celera Gene: hCG25213.3
OMIM number: 154540
OMIM Information: MANNOSE 6-PHOSPHATE RECEPTOR, CATION-DEPENDENT;M6PR
Transcript SEQ ID NO: 1131
Celera Transcript: hCT1961746.1

Peptide SEQ ID NO: 1346 (20-28) Tissue AS210 , ratio = 5.6

======

Protein SEQ ID NO: 475
Celera Protein: hCP1774863.1
Celera Gene: hCG25213.3
OMIM number: 154540
OMIM Information: MANNOSE 6-PHOSPHATE RECEPTOR, CATION-DEPENDENT;M6PR
Transcript SEQ ID NO: 1132
Celera Transcript: hCT1961749.1

Protein SEQ ID NO: 476
Celera Protein: hCP1774860.1
Celera Gene: hCG25213.3
OMIM number: 154540
OMIM Information: MANNOSE 6-PHOSPHATE RECEPTOR, CATION-DEPENDENT;M6PR
Transcript SEQ ID NO: 1133
Celera Transcript: hCT1961747.1

Protein SEQ ID NO: 477
Public Protein Accession: P20645
Protein Name: Human cation-dependent mannose-6-phosphate receptor (CD-MPR) protein
Transcript SEQ ID NO: 1134
Public Transcript Accession: M16985

Peptide SEQ ID NO: 1346 (138-146) Tissue AS210 , ratio = 5.6

======

Protein SEQ ID NO: 478
Celera Protein: hCP1762176
Celera Gene: hCG201355.3
Transcript SEQ ID NO: 1135
Celera Transcript: hCT1953193.1

Peptide SEQ ID NO: 1480 (71-78) Tissue GW215 , ratio = Singleton

======

Protein SEQ ID NO: 479
Celera Protein: hCP1762254
Celera Gene: hCG201355.3
Transcript SEQ ID NO: 1136
Celera Transcript: hCT1953194.1

Peptide SEQ ID NO: 1480 (123-130) Tissue GW215 , ratio = Singleton

======

Protein SEQ ID NO: 480
Public Protein Accession: NP_005753.1 Q13263
Protein Name: Transcription intermediary factor 1-beta (TIF1-beta) (Tripartite motif protein 28) (Nuclear corepressor KAP-1) (KRAB-associated protein 1)
Transcript SEQ ID NO: 1137
Public Transcript Accession: NM_005762

Protein SEQ ID NO: 481
Celera Protein: hCP201747.1
Celera Gene: hCG201355.3
Transcript SEQ ID NO: 1138
Celera Transcript: hCT201356.3

Peptide SEQ ID NO: 1480 (205-212) Tissue GW215 , ratio = Singleton

-continued

======

Protein SEQ ID NO: 482
Celera Protein: hCP1739429.1
Celera Gene: hCG1780053.2
OMIM number: 176763
OMIM Information: PEROXIREDOXIN 1;PRDX1
Transcript SEQ ID NO: 1139
Celera Transcript: hCT1818876.2

Protein SEQ ID NO: 483
Celera Protein: hCP1810219
Celera Gene: hCG1780053.2
OMIM number: 176763
OMIM Information: PEROXIREDOXIN 1;PRDX1
Transcript SEQ ID NO: 1140
Celera Transcript: hCT2333971

Protein SEQ ID NO: 484
Celera Protein: hCP1777892
Celera Gene: hCG1780053.2
OMIM number: 176763
OMIM Information: PEROXIREDOXIN 1;PRDX1
Transcript SEQ ID NO: 1141
Celera Transcript: hCT1962880.1

Protein SEQ ID NO: 485
Public Protein Accession: Q06830
Protein Name: Peroxiredoxin 1 (EC 1.11.1.-) (Thioredoxin peroxidase 2) (Thioredoxin- dependent peroxide reductase 2) (Proliferation-associated protein PAG) (Natural killer cell enhancing factor A) (NKEF-A)
Transcript SEQ ID NO: 1142
Public Transcript Accession: X67951

Protein SEQ ID NO: 486
Celera Protein: hCP1781494
Celera Gene: hCG1780053.2
OMIM number: 176763
OMIM Information: PEROXIREDOXIN 1;PRDX1
Transcript SEQ ID NO: 1143
Celera Transcript: hCT1966792.1

Protein SEQ ID NO: 487
Celera Protein: hCP1777916
Celera Gene: hCG1780053.2
OMIM number: 176763
OMIM Information: PEROXIREDOXIN 1;PRDX1
Transcript SEQ ID NO: 1144
Celera Transcript: hCT1962879.1

Protein SEQ ID NO: 488
Celera Protein: hCP1810218
Celera Gene: hCG1780053.2
OMIM number: 176763
OMIM Information: PEROXIREDOXIN 1;PRDX1
Transcript SEQ ID NO: 1145
Celera Transcript: hCT2333968

Peptide SEQ ID NO: 1404 (168-189) Tissue AS210 , ratio = Singleton

======

Protein SEQ ID NO: 489
Public Protein Accession: P01903
Protein Name: HLA-DR alpha chain ovarian tumour marker protein, SEQ ID NO:41
Transcript SEQ ID NO: 1146
Public Transcript Accession: K01171

Protein SEQ ID NO: 490
Celera Protein: hCP52121
Celera Gene: hCG43709.3
OMIM number: 142860
OMIM Information: MAJOR HISTOCOMPATIBILITY COMPLEX, CLASS II, DR ALPHA;HLA-DRA
Transcript SEQ ID NO: 1147
Celera Transcript: hCT34994.3

Protein SEQ ID NO: 491
Celera Protein: hCP1854412
Celera Gene: hCG43709.3
OMIM number: 142860

-continued

OMIM Information: MAJOR HISTOCOMPATIBILITY COMPLEX, CLASS II, DR ALPHA;HLA-DRA
Transcript SEQ ID NO: 1148
Celera Transcript: hCT2283093

Peptide SEQ ID NO: 1423 (171-188) Tissue AS210 , ratio = >2.6
Peptide SEQ ID NO: 1423 (171-188) Tissue GW215 , ratio = Singleton

======

Protein SEQ ID NO: 492
Celera Protein: hCP1763812
Celera Gene: hCG43709.3
OMIM number: 142860
OMIM Information: MAJOR HISTOCOMPATIBILITY COMPLEX, CLASS II, DR ALPHA;HLA-DRA
Transcript SEQ ID NO: 1149
Celera Transcript: hCT1954324

Peptide SEQ ID NO: 1423 (124-141) Tissue AS210 , ratio = >2.6
Peptide SEQ ID NO: 1423 (124-141) Tissue GW215 , ratio = Singleton

======

Protein SEQ ID NO: 493
Public Protein Accession: NP_004563.1 Q99959
Protein Name: Plakophilin 2
Transcript SEQ ID NO: 1150
Public Transcript Accession: NM_004572

Peptide SEQ ID NO: 1350 (578-590) Tissue GW215 , ratio = Singleton

======

Protein SEQ ID NO: 494
Celera Protein: hCP1764721.1
Celera Gene: hCG1685949.3
OMIM number: 602861
OMIM Information: PLAKOPHILIN 2;PKP2
Transcript SEQ ID NO: 1151
Celera Transcript: hCT1950850.1

Peptide SEQ ID NO: 1350 (534-546) Tissue GW215 , ratio = Singleton

======

Protein SEQ ID NO: 495
Celera Protein: hCP1900225
Celera Gene: hCG1685949.3
OMIM number: 602861
OMIM Information: PLAKOPHILIN 2;PKP2
Transcript SEQ ID NO: 1152
Celera Transcript: hCT2284346

Peptide SEQ ID NO: 1350 (578-590) Tissue GW215 , ratio = Singleton

======

Protein SEQ ID NO: 496
Celera Protein: hCP1900226
Celera Gene: hCG1685949.3
OMIM number: 602861
OMIM Information: PLAKOPHILIN 2;PKP2
Transcript SEQ ID NO: 1153
Celera Transcript: hCT2284344

Peptide SEQ ID NO: 1350 (534-546) Tissue GW215 , ratio = Singleton

======

Protein SEQ ID NO: 497
Celera Protein: hCP1692035.2
Celera Gene: hCG1685949.3
OMIM number: 602861
OMIM Information: PLAKOPHILIN 2;PKP2
Transcript SEQ ID NO: 1154
Celera Transcript: hCT1686878.2

Peptide SEQ ID NO: 1350 (578-590) Tissue GW215 , ratio = Singleton

======

Protein SEQ ID NO: 498
Public Protein Accession: XP_114346.2
Protein Name: Source of immunodominant MHC-associated peptides Protein SEQ ID NO: 499
Celera Protein: hCP43541.4
Celera Gene: hCG28015.3
Transcript SEQ ID NO: 1155
Celera Transcript: hCT19161.3

Peptide SEQ ID NO: 1337 (706-718) Tissue AS210 , ratio = Singleton

======

Protein SEQ ID NO: 500
Celera Protein: hCP1793056.1
Celera Gene: hCG2006859.1
OMIM number: 188840
OMIM Information: TITIN;TTN
Transcript SEQ ID NO: 1156
Celera Transcript: hCT2294316.1

Protein SEQ ID NO: 501
Celera Protein: hCP1793061.1
Celera Gene: hCG2006859.1
OMIM number: 188840
OMIM Information: TITIN;TTN
Transcript SEQ ID NO: 1157
Celera Transcript: hCT2294313.1

Peptide SEQ ID NO: 1422 (14-19) Tissue AS210 , ratio = Singleton

======

Protein SEQ ID NO: 502
Celera Protein: hCP1904408
Celera Gene: hCG2017385
OMIM number: 135630
OMIM Information: INTEGRIN, BETA-1;ITGB1
Transcript SEQ ID NO: 1158
Celera Transcript: hCT2310893

Protein SEQ ID NO: 503
Public Protein Accession: Q14647
Protein Name: Protein differentially regulated in prostate cancer #65
Transcript SEQ ID NO: 1159
Public Transcript Accession: X07979

Protein SEQ ID NO: 504
Celera Protein: hCP1904412
Celera Gene: hCG2017385
OMIM number: 135630
OMIM Information: INTEGRIN, BETA-1;ITGB1
Transcript SEQ ID NO: 1160
Celera Transcript: hCT2310897

Protein SEQ ID NO: 505
Public Protein Accession: NP_596867.1
Protein Name: Hypothetical protein
Transcript SEQ ID NO: 1161
Public Transcript Accession: NM_133376

Protein SEQ ID NO: 506
Celera Protein: hCP1904415
Celera Gene: hCG2017385
OMIM number: 135630
OMIM Information: INTEGRIN, BETA-1;ITGB1
Transcript SEQ ID NO: 1162
Celera Transcript: hCT2310899

Protein SEQ ID NO: 507
Celera Protein: hCP1904418
Celera Gene: hCG2017385
OMIM number: 135630
OMIM Information: INTEGRIN, BETA-1;ITGB1
Transcript SEQ ID NO: 1163
Celera Transcript: hCT2310895

Protein SEQ ID NO: 508
Celera Protein: hCP1904410

-continued

Celera Gene: hCG2017385
OMIM number: 135630
OMIM Information: INTEGRIN, BETA-1;ITGB1
Transcript SEQ ID NO: 1164
Celera Transcript: hCT2310889

Protein SEQ ID NO: 509
Celera Protein: hCP1904419
Celera Gene: hCG2017385
OMIM number: 135630
OMIM Information: INTEGRIN, BETA-1;ITGB1
Transcript SEQ ID NO: 1165
Celera Transcript: hCT2310898

Protein SEQ ID NO: 510
Celera Protein: hCP1904405
Celera Gene: hCG2017385
OMIM number: 135630
OMIM Information: INTEGRIN, BETA-1;ITGB1
Transcript SEQ ID NO: 1166
Celera Transcript: hCT2310886

Protein SEQ ID NO: 511
Celera Protein: hCP1904409
Celera Gene: hCG2017385
OMIM number: 135630
OMIM Information: INTEGRIN, BETA-1;ITGB1
Transcript SEQ ID NO: 1167
Celera Transcript: hCT2310894

Protein SEQ ID NO: 512
Celera Protein: hCP1904413
Celera Gene: hCG2017385
OMIM number: 135630
OMIM Information: INTEGRIN, BETA-1;ITGB1
Transcript SEQ ID NO: 1168
Celera Transcript: hCT2310891

Protein SEQ ID NO: 513
Public Protein Accession: NP_391988.1
Protein Name: integrin beta 1 isoform 1D precursor; integrin VLA-4 beta subunit; fibronectin receptor beta subunit [Homo sapiens]
Transcript SEQ ID NO: 1169
Public Transcript Accession: NM_033668

Protein SEQ ID NO: 514
Public Protein Accession: NP_391989.1
Protein Name: integrin beta 1 isoform 1C-2 precursor; integrin VLA-4 beta subunit; fibronectin receptor beta subunit [Homo sapiens]
Transcript SEQ ID NO: 1170
Public Transcript Accession: NM_033669

Protein SEQ ID NO: 515
Celera Protein: hCP1904411
Celera Gene: hCG2017385
OMIM number: 135630
OMIM Information: INTEGRIN, BETA-1;ITGB1
Transcript SEQ ID NO: 1171
Celera Transcript: hCT2310884

Protein SEQ ID NO: 516
Celera Protein: hCP1904414
Celera Gene: hCG2017385
OMIM number: 135630
OMIM Information: INTEGRIN, BETA-1;ITGB1
Transcript SEQ ID NO: 1172
Celera Transcript: hCT2310885

Protein SEQ ID NO: 517
Celera Protein: hCP1904416
Celera Gene: hCG2017385
OMIM number: 135630
OMIM Information: INTEGRIN, BETA-1;ITGB1
Transcript SEQ ID NO: 1173
Celera Transcript: hCT2310883

Protein SEQ ID NO: 518
Celera Protein: hCP1904417
Celera Gene: hCG2017385
OMIM number: 135630
OMIM Information: INTEGRIN, BETA-1;ITGB1
Transcript SEQ ID NO: 1174

-continued

Celera Transcript: hCT2310896

Protein SEQ ID NO: 519
Celera Protein: hCP1904407
Celera Gene: hCG2017385
OMIM number: 135630
OMIM Information: INTEGRIN, BETA-1;ITGB1
Transcript SEQ ID NO: 1175
Celera Transcript: hCT2310887

Protein SEQ ID NO: 520
Celera Protein: hCP1904420
Celera Gene: hCG2017385
OMIM number: 135630
OMIM Information: INTEGRIN, BETA-1;ITGB1
Transcript SEQ ID NO: 1176
Celera Transcript: hCT2310890

Protein SEQ ID NO: 521
Public Protein Accession: NP_389647.1
Protein Name: integrin beta 1 isoform 1B precursor; integrin VLA-4 beta subunit; fibronectin receptor beta subunit [Homo sapiens]
Transcript SEQ ID NO: 1177
Public Transcript Accession: NM_033666

Peptide SEQ ID NO: 1349 (63-71) Tissue AS210 , ratio = 3.5

======

Protein SEQ ID NO: 522
Celera Protein: hCP1904421
Celera Gene: hCG2017385
OMIM number: 135630
OMIM Information: INTEGRIN, BETA-1;ITGB1
Transcript SEQ ID NO: 1178
Celera Transcript: hCT2310888

Peptide SEQ ID NO: 1349 (6-14) Tissue AS210 , ratio = 3.5

======

Protein SEQ ID NO: 523
Celera Protein: hCP1904406
Celera Gene: hCG2017385
OMIM number: 135630
OMIM Information: INTEGRIN, BETA-1;ITGB1
Transcript SEQ ID NO: 1179
Celera Transcript: hCT2310892

Protein SEQ ID NO: 524
Public Protein Accession: NP_391987.1
Protein Name: integrin beta 1 isoform 1C-1 precursor; integrin VLA-4 beta subunit; fibronectin receptor beta subunit [Homo sapiens]
Transcript SEQ ID NO: 1180
Public Transcript Accession: NM_033667

Peptide SEQ ID NO: 1349 (63-71) Tissue AS210 , ratio = 3.5

======

Protein SEQ ID NO: 525
Celera Protein: hCP1785822
Celera Gene: hCG2023561
Transcript SEQ ID NO: 1181
Celera Transcript: hCT2320704

Protein SEQ ID NO: 526
Celera Protein: hCP1785820
Celera Gene: hCG2023561
Transcript SEQ ID NO: 1182
Celera Transcript: hCT2320701

Protein SEQ ID NO: 527
Celera Protein: hCP1785819
Celera Gene: hCG2023561
Transcript SEQ ID NO: 1183
Celera Transcript: hCT2320703

Protein SEQ ID NO: 528
Public Protein Accession: Q9Y5M8
Protein Name: Signal recognition particle receptor beta subunit (SR-beta) (Protein APMCF1)

-continued

Protein SEQ ID NO: 529
Public Protein Accession: Q9Y5M8
Protein Name: Hypothetical protein HEMBA1006391
Transcript SEQ ID NO: 1184
Public Transcript Accession: AF141882

Peptide SEQ ID NO: 1345 (65-76) Tissue AS210 , ratio = Singleton

======

Protein SEQ ID NO: 530
Public Protein Accession: XP_136108.3
Protein Name: RIKEN cDNA C430014N20 gene [Mus musculus]
Transcript SEQ ID NO: 1185
Public Transcript Accession: XM_136108

Peptide SEQ ID NO: 1382 (524-541) Tissue AS210 , ratio = 2.3

======

Protein SEQ ID NO: 531
Celera Protein: hCP1779654
Celera Gene: hCG15998.2
Transcript SEQ ID NO: 1186
Celera Transcript: hCT1964912.1

Protein SEQ ID NO: 532
Celera Protein: hCP34901.3
Celera Gene: hCG15998.2
Transcript SEQ ID NO: 1187
Celera Transcript: hCT7028.2

Protein SEQ ID NO: 533
Celera Protein: hCP1885327
Celera Gene: hCG15998.2
Transcript SEQ ID NO: 1188
Celera Transcript: hCT2275710

Peptide SEQ ID NO: 1413 (108-127) Tissue AS210 , ratio = >1.9

======

Protein SEQ ID NO: 534
Public Protein Accession: XP_046677.5
Protein Name: solute carrier family 39 (zinc transporter), member 14 [Homo sapiens]
Transcript SEQ ID NO: 1189
Public Transcript Accession: XM_046677

Peptide SEQ ID NO: 1413 (173-192) Tissue AS210 , ratio = >1.9

======

Protein SEQ ID NO: 535
Celera Protein: hCP1885326
Celera Gene: hCG15998.2
Transcript SEQ ID NO: 1190
Celera Transcript: hCT2275712

Peptide SEQ ID NO: 1413 (108-127) Tissue AS210 , ratio = >1.9

======

Protein SEQ ID NO: 536
Celera Protein: hCP33409.2
Celera Gene: hCG15697.2
Transcript SEQ ID NO: 1191
Celera Transcript: hCT6722.3

Peptide SEQ ID NO: 1441 (721-741) Tissue GW215 , ratio = Singleton

======

Protein SEQ ID NO: 537
Celera Protein: hCP1888856
Celera Gene: hCG41341.2
OMIM number: 300017
OMIM Information: FILAMIN A;FLNA
Transcript SEQ ID NO: 1192
Celera Transcript: hCT2291391

-continued

Peptide SEQ ID NO: 1501 (245-250) Tissue GW215 , ratio = Singleton
Peptide SEQ ID NO: 1474 (1124-1132) Tissue GW215 , ratio = Singleton

======

Protein SEQ ID NO: 538
Celera Protein: hCP1736509.2
Celera Gene: hCG1726843.2
Transcript SEQ ID NO: 1193
Celera Transcript: hCT1764595.2

Protein SEQ ID NO: 539
Public Protein Accession: P31949
Protein Name: Calgizzarin (S100C protein) (MLN 70)
Transcript SEQ ID NO: 1194
Public Transcript Accession: D50374

Protein SEQ ID NO: 540
Celera Protein: hCP33584.2
Celera Gene: hCG16921.3
OMIM number: 603114
OMIM Information: S100 CALCIUM-BINDING PROTEIN A11;S100A11
Transcript SEQ ID NO: 1195
Celera Transcript: hCT7962.2

Protein SEQ ID NO: 541
Public Protein Accession: O60417
Protein Name: S100 calcium-binding protein A14

Protein SEQ ID NO: 542
Celera Protein: hCP1904699
Celera Gene: hCG2013819
Transcript SEQ ID NO: 1196
Celera Transcript: hCT2305048

Peptide SEQ ID NO: 1355 (12-22) Tissue AS210 , ratio = Singleton

======

Protein SEQ ID NO: 543
Celera Protein: hCP1895194
Celera Gene: hCG27034.3
OMIM number: 600840
OMIM Information: SOLUTE CARRIER FAMILY 12, MEMBER 2;SLC12A2
Transcript SEQ ID NO: 1197
Celera Transcript: hCT2254454

Protein SEQ ID NO: 544
Celera Protein: hCP44322.2
Celera Gene: hCG27034.3
OMIM number: 600840
OMIM Information: SOLUTE CARRIER FAMILY 12, MEMBER 2;SLC12A2
Transcript SEQ ID NO: 1198
Celera Transcript: hCT18167.3

Protein SEQ ID NO: 545
Public Protein Accession: NP_001037.1 P55011
Protein Name: Human colorectal cancer modulator protein, CAA9
Transcript SEQ ID NO: 1199
Public Transcript Accession: NM_001046

Peptide SEQ ID NO: 1412 (624-630) Tissue AS210 , ratio = 5.1
Peptide SEQ ID NO: 1412 (624-630) Tissue GW215 , ratio = 4.0

======

Protein SEQ ID NO: 546
Celera Protein: hCP1904955
Celera Gene: hCG16932.2
Transcript SEQ ID NO: 1200
Celera Transcript: hCT2305085

Protein SEQ ID NO: 547
Celera Protein: hCP36018.2
Celera Gene: hCG16932.2
Transcript SEQ ID NO: 1201
Celera Transcript: hCT7975.3

Peptide SEQ ID NO: 1409 (179-193) Tissue AS210 , ratio = 2.2

======

Protein SEQ ID NO: 548
Celera Protein: hCP1774631
Celera Gene: hCG16932.2
Transcript SEQ ID NO: 1202
Celera Transcript: hCT1961883.1

Peptide SEQ ID NO: 1409 (161-175) Tissue AS210 , ratio = 2.2

======

Protein SEQ ID NO: 549
Public Protein Accession: NP_006745.1 Q16563
Protein Name: PANTOPHYSIN
Transcript SEQ ID NO: 1203
Public Transcript Accession: NM_006754

Peptide SEQ ID NO: 1409 (179-193) Tissue AS210 , ratio = 2.2

======

Protein SEQ ID NO: 550
Celera Protein: hCP1761626
Celera Gene: hCG1811721.1
Transcript SEQ ID NO: 1204
Celera Transcript: hCT1954032

Protein SEQ ID NO: 551
Public Protein Accession: Q96RQ3
Protein Name: Human protein sequence SEQ ID NO:14972
Transcript SEQ ID NO: 1205
Public Transcript Accession: AK023051

Peptide SEQ ID NO: 1380 (505-517) Tissue AS210 , ratio = Singleton

======

Protein SEQ ID NO: 552
Celera Protein: hCP1897380
Celera Gene: hCG25781.3
Transcript SEQ ID NO: 1206
Celera Transcript: hCT2321399

Peptide SEQ ID NO: 1450 (374-384) Tissue AS210 , ratio = 2.7
Peptide SEQ ID NO: 1495 (15-26) Tissue AS210 , ratio = 7.6

======

Protein SEQ ID NO: 553
Celera Protein: hCP42477.3
Celera Gene: hCG25781.3
Transcript SEQ ID NO: 1207
Celera Transcript: hCT16908.3

Protein SEQ ID NO: 554
Celera Protein: hCP1897384
Celera Gene: hCG25781.3
Transcript SEQ ID NO: 1208
Celera Transcript: hCT2321398

Protein SEQ ID NO: 555
Public Protein Accession: Q9HD45
Protein Name: Transmembrane 9 superfamily protein member 3 precursor (SM-11044 binding protein) (EP70-P-iso)

Peptide SEQ ID NO: 1450 (418-428) Tissue AS210 , ratio = 2.7
Peptide SEQ ID NO: 1495 (59-70) Tissue AS210 , ratio = 7.6

======

Protein SEQ ID NO: 556
Celera Protein: hCP1863383
Celera Gene: hCG2019292
Transcript SEQ ID NO: 1209
Celera Transcript: hCT2313872

Protein SEQ ID NO: 557
Public Protein Accession: P18282
Protein Name: Destrin (Actin-depolymerizing factor) (ADF)
Transcript SEQ ID NO: 1210

-continued

Public Transcript Accession: BC009477

Peptide SEQ ID NO: 1344 (34-44) Tissue AS210 , ratio = Singleton
Peptide SEQ ID NO: 1344 (34-44) Tissue GW215 , ratio = Singleton

======

Protein SEQ ID NO: 558
Celera Protein: hCP1863384
Celera Gene: hCG2019292
Transcript SEQ ID NO: 1211
Celera Transcript: hCT2313873

Peptide SEQ ID NO: 1344 (17-27) Tissue AS210 , ratio = Singleton
Peptide SEQ ID NO: 1344 (17-27) Tissue GW215 , ratio = Singleton

======

Protein SEQ ID NO: 559
Public Protein Accession: NP_958833.1
Protein Name: Truncated RTN3-A-D8
Transcript SEQ ID NO: 1212
Public Transcript Accession: NM_201430

Protein SEQ ID NO: 560
Celera Protein: hCP1902910
Celera Gene: hCG1775344.2
OMIM number: 604249
OMIM Information: RETICULON 3;RTN3
Transcript SEQ ID NO: 1213
Celera Transcript: hCT2310252

Protein SEQ ID NO: 561
Celera Protein: hCP48648.3
Celera Gene: hCG38771.3
Transcript SEQ ID NO: 1214
Celera Transcript: hCT30016.3

Protein SEQ ID NO: 562
Public Protein Accession: NP_006045.1 O95197
Protein Name: RTN3-A1
Transcript SEQ ID NO: 1215
Public Transcript Accession: NM_006054

Protein SEQ ID NO: 563
Celera Protein: hCP1739764.1
Celera Gene: hCG1775344.2
OMIM number: 604249
OMIM Information: RETICULON 3;RTN3
Transcript SEQ ID NO: 1216
Celera Transcript: hCT1814006.2

Protein SEQ ID NO: 564
Public Protein Accession: XP_017966.4
Protein Name: similar to Reticulon protein 3 (Neuroendocrine-specific protein-like 2) (NSP-like protein II) (NSPLII) [Homo sapiens]
Transcript SEQ ID NO: 1217
Public Transcript Accession: XM_017966

Peptide SEQ ID NO: 1460 (40-54) Tissue AS210 , ratio = Singleton

======

Protein SEQ ID NO: 565
Public Protein Accession: XP_088476.1 Q9BS26
Protein Name: ERp44 protein precursor Peptide SEQ ID NO: 1400 (291-304) Tissue AS210 , ratio = 5.6

======

Protein SEQ ID NO: 566
Public Protein Accession: XP_376898.1
Protein Name: thioredoxin domain containing 4 (endoplasmic reticulum) [Homo sapiens]
Transcript SEQ ID NO: 1218
Public Transcript Accession: XM_376898

Peptide SEQ ID NO: 1400 (408-421) Tissue AS210 , ratio = 5.6

======

-continued

Protein SEQ ID NO: 567
Celera Protein: hCP1859321
Celera Gene: hCG1995098.1
OMIM number: 147586
OMIM Information: INTERFERON-GAMMA-INDUCIBLE PROTEIN 16;IFI16
Transcript SEQ ID NO: 1219
Celera Transcript: hCT2275171.1

Peptide SEQ ID NO: 1442 (336-344) Tissue GW215 , ratio = Singleton

======

Protein SEQ ID NO: 568
Celera Protein: hCP1859322.1
Celera Gene: hCG1995098.1
OMIM number: 147586
OMIM Information: INTERFERON-GAMMA-INDUCIBLE PROTEIN 16;IFI16
Transcript SEQ ID NO: 1220
Celera Transcript: hCT2275176.1

Peptide SEQ ID NO: 1442 (367-375) Tissue GW215 , ratio = Singleton

======

Protein SEQ ID NO: 569
Celera Protein: hCP1859323.1
Celera Gene: hCG1995098.1
OMIM number: 147586
OMIM Information: INTERFERON-GAMMA-INDUCIBLE PROTEIN 16;IFI16
Transcript SEQ ID NO: 1221
Celera Transcript: hCT2275174.1

Peptide SEQ ID NO: 1442 (21-29) Tissue GW215 , ratio = Singleton

======

Protein SEQ ID NO: 570
Celera Protein: hCP1859318.1
Celera Gene: hCG1995098.1
OMIM number: 147586
OMIM Information: INTERFERON-GAMMA-INDUCIBLE PROTEIN 16;IFI16
Transcript SEQ ID NO: 1222
Celera Transcript: hCT2275177.1

Peptide SEQ ID NO: 1442 (738-746) Tissue GW215 , ratio = Singleton

======

Protein SEQ ID NO: 571
Celera Protein: hCP1859319
Celera Gene: hCG1995098
OMIM number: 147586
OMIM Information: INTERFERON-GAMMA-INDUCIBLE PROTEIN 16;IFI16
Transcript SEQ ID NO: 1223
Celera Transcript: hCT2275172

Protein SEQ ID NO: 572
Celera Protein: hCP1859320
Celera Gene: hCG1995098
OMIM number: 147586
OMIM Information: INTERFERON-GAMMA-INDUCIBLE PROTEIN 16;IFI16
Transcript SEQ ID NO: 1224
Celera Transcript: hCT2275173

Peptide SEQ ID NO: 1442 (682-690) Tissue GW215 , ratio = Singleton

======

Protein SEQ ID NO: 573
Public Protein Accession: NP_064508.1
Protein Name: endomembrane protein emp70 precursor isolog [Homo sapiens]
Transcript SEQ ID NO: 1225
Public Transcript Accession: NM_020123

Peptide SEQ ID NO: 1495 (58-69) Tissue AS210 , ratio = 7.6

======

Protein SEQ ID NO: 574
Celera Protein: hCP1888858

-continued

Celera Gene: hCG41341.2
OMIM number: 300017
OMIM Information: FILAMIN A;FLNA
Transcript SEQ ID NO: 1226
Celera Transcript: hCT2291392

Peptide SEQ ID NO: 1474 (301-309) Tissue GW215 , ratio = Singleton

======

Protein SEQ ID NO: 575
Celera Protein: hCP1888857
Celera Gene: hCG41341.2
OMIM number: 300017
OMIM Information: FILAMIN A;FLNA
Transcript SEQ ID NO: 1227
Celera Transcript: hCT2291393

Peptide SEQ ID NO: 1474 (281-289) Tissue GW215 , ratio = Singleton

======

Protein SEQ ID NO: 576
Celera Protein: hCP33810.2
Celera Gene: hCG17636.3
Transcript SEQ ID NO: 1228
Celera Transcript: hCT8688.3

Protein SEQ ID NO: 577
Public Protein Accession: Q13162
Protein Name: Peroxiredoxin 4 (EC 1.11.1.-) (Prx-IV) (Thioredoxin peroxidase AO372) (Thioredoxin-dependent peroxide reductase A0372) (Antioxidant enzyme AOE372) (AOE37-2)
Transcript SEQ ID NO: 1229
Public Transcript Accession: BC003609

Peptide SEQ ID NO: 1479 (45-65) Tissue GW215 , ratio = Singleton

======

Protein SEQ ID NO: 578
Celera Protein: hCP1901956
Celera Gene: hCG2017131
OMIM number: 164009
OMIM Information: NUCLEAR MITOTIC APPARATUS PROTEIN 1;NUMA1
Transcript SEQ ID NO: 1230
Celera Transcript: hCT2310498

Protein SEQ ID NO: 579
Celera Protein: hCP1901957
Celera Gene: hCG2017131
OMIM number: 164009
OMIM Information: NUCLEAR MITOTIC APPARATUS PROTEIN 1;NUMA1
Transcript SEQ ID NO: 1231
Celera Transcript: hCT2310495

Protein SEQ ID NO: 580
Celera Protein: hCP1901952
Celera Gene: hCG2017131
OMIM number: 164009
OMIM Information: NUCLEAR MITOTIC APPARATUS PROTEIN 1;NUMA1
Transcript SEQ ID NO: 1232
Celera Transcript: hCT2310496

Protein SEQ ID NO: 581
Celera Protein: hCP1901951
Celera Gene: hCG2017131
OMIM number: 164009
OMIM Information: NUCLEAR MITOTIC APPARATUS PROTEIN 1;NUMA1
Transcript SEQ ID NO: 1233
Celera Transcript: hCT2310492

Protein SEQ ID NO: 582
Celera Protein: hCP1901950
Celera Gene: hCG2017131
OMIM number: 164009
OMIM Information: NUCLEAR MITOTIC APPARATUS PROTEIN 1;NUMA1
Transcript SEQ ID NO: 1234
Celera Transcript: hCT2310500

Protein SEQ ID NO: 583

-continued

Celera Protein: hCP1901958
Celera Gene: hCG2017131
OMIM number: 164009
OMIM Information: NUCLEAR MITOTIC APPARATUS PROTEIN 1;NUMA1
Transcript SEQ ID NO: 1235
Celera Transcript: hCT2310497

Protein SEQ ID NO: 584
Celera Protein: hCP1901946
Celera Gene: hCG2017131
OMIM number: 164009
OMIM Information: NUCLEAR MITOTIC APPARATUS PROTEIN 1;NUMA1
Transcript SEQ ID NO: 1236
Celera Transcript: hCT2310494

Protein SEQ ID NO: 585
Celera Protein: hCP1901949
Celera Gene: hCG2017131
OMIM number: 164009
OMIM Information: NUCLEAR MITOTIC APPARATUS PROTEIN 1;NUMA1
Transcript SEQ ID NO: 1237
Celera Transcript: hCT2310499

Protein SEQ ID NO: 586
Celera Protein: hCP1901959
Celera Gene: hCG2017131
OMIM number: 164009
OMIM Information: NUCLEAR MITOTIC APPARATUS PROTEIN 1;NUMA1
Transcript SEQ ID NO: 1238
Celera Transcript: hCT2310493

Peptide SEQ ID NO: 1430 (60-69) Tissue AS210 , ratio = Singleton

======

Protein SEQ ID NO: 587
Celera Protein: hCP801007.1
Celera Gene: hCG401084.3
OMIM number: 114830
OMIM Information: CARBONYL REDUCTASE 1;CBR1
Transcript SEQ ID NO: 1239
Celera Transcript: hCT401084.3

Peptide SEQ ID NO: 1373 (119-133) Tissue AS210 , ratio = Singleton

======

Protein SEQ ID NO: 588
Public Protein Accession: P16152
Protein Name: Carbonyl reductase [NADPH] 1 (EC 1.1.1.184) (NADPH-dependent carbonyl reductase 1) (Prostaglandin-E2 9-reductase) (EC 1.1.1.189) (Prostaglandin 9-ketoreductase) (15-hydroxyprostaglandin dehydrogenase [NADP+]) (EC 1.1.1.197)
Transcript SEQ ID NO: 1240
Public Transcript Accession: BC002511

Peptide SEQ ID NO: 1373 (118-132) Tissue AS210 , ratio = Singleton

======

Protein SEQ ID NO: 589
Celera Protein: hCP1906045
Celera Gene: hCG24350.3
OMIM number: 106490
OMIM Information: ANNEXIN A3;ANXA3
Transcript SEQ ID NO: 1241
Celera Transcript: hCT2327967

Protein SEQ ID NO: 590
Celera Protein: hCP1765152
Celera Gene: hCG24350.3
OMIM number: 106490
OMIM Information: ANNEXIN A3;ANXA3
Transcript SEQ ID NO: 1242
Celera Transcript: hCT1955557.1

Protein SEQ ID NO: 591
Public Protein Accession: P12429
Protein Name: Annexin A3 (Annexin III) (Lipocortin III) (Placental anticoagulant protein III) (PAP-III) (35-alpha calcimedin) (Inositol 1,2-cyclic phosphate 2-phosphohydrolase)
Transcript SEQ ID NO: 1243
Public Transcript Accession: M63310

Peptide SEQ ID NO: 1493 (189-203) Tissue AS210 , ratio = Singleton

======

Protein SEQ ID NO: 592
Celera Protein: hCP1906046
Celera Gene: hCG24350.3
OMIM number: 106490
OMIM Information: ANNEXIN A3;ANXA3
Transcript SEQ ID NO: 1244
Celera Transcript: hCT2327966

Peptide SEQ ID NO: 1493 (150-164) Tissue AS210 , ratio = Singleton

======

Protein SEQ ID NO: 593
Celera Protein: hCP41585.2
Celera Gene: hCG24350.3
OMIM number: 106490
OMIM Information: ANNEXIN A3;ANXA3
Transcript SEQ ID NO: 1245
Celera Transcript: hCT15468.2

Peptide SEQ ID NO: 1493 (189-203) Tissue AS210 , ratio = Singleton

======

Protein SEQ ID NO: 594
Celera Protein: hCP1857997
Celera Gene: hCG37145.3
OMIM number: 190196
OMIM Information: TRANSGLUTAMINASE 2;TGM2
Transcript SEQ ID NO: 1246
Celera Transcript: hCT2313021

Protein SEQ ID NO: 595
Public Protein Accession: NP_004604.1
Protein Name: Amino acid sequence of human transglutaminase 2
Transcript SEQ ID NO: 1247
Public Transcript Accession: NM_004613

Protein SEQ ID NO: 596
Celera Protein: hCP47973.2
Celera Gene: hCG37145.3
OMIM number: 190196
OMIM Information: TRANSGLUTAMINASE 2;TGM2
Transcript SEQ ID NO: 1248
Celera Transcript: hCT28375.3

Protein SEQ ID NO: 597
Public Protein Accession: P21980
Protein Name: Protein-glutamine gamma-glutamyltransferase (EC 2.3.2.13) (Tissue transglutaminase) (TGase C) (TGC) (TG(C)) (Tranglutaminase 2) (TGase-H)

Protein SEQ ID NO: 598
Celera Protein: hCP1857998
Celera Gene: hCG37145.3
OMIM number: 190196
OMIM Information: TRANSGLUTAMINASE 2;TGM2
Transcript SEQ ID NO: 1249
Celera Transcript: hCT2313025

Protein SEQ ID NO: 599
Celera Protein: hCP1857996
Celera Gene: hCG37145.3
OMIM number: 190196
OMIM Information: TRANSGLUTAMINASE 2;TGM2
Transcript SEQ ID NO: 1250
Celera Transcript: hCT2313026

Protein SEQ ID NO: 600
Celera Protein: hCP1858002
Celera Gene: hCG37145.3
OMIM number: 190196
OMIM Information: TRANSGLUTAMINASE 2;TGM2
Transcript SEQ ID NO: 1251
Celera Transcript: hCT2313024

-continued

Peptide SEQ ID NO: 1437 (506-511) Tissue GW215 , ratio = Singleton

======

Protein SEQ ID NO: 601
Celera Protein: hCP1895436
Celera Gene: hCG2033721
OMIM number: 603182
OMIM Information: INTERLEUKIN ENHANCER-BINDING FACTOR 3;ILF3
Transcript SEQ ID NO: 1252
Celera Transcript: hCT2336765

Protein SEQ ID NO: 602
Public Protein Accession: NP_036350.2
Protein Name: interleukin enhancer binding factor 3 isoform a; double-stranded RNA-binding protein, 76 kD; M-phase phosphoprotein 4; nuclear factor associated with dsRNA; nuclear factor of activated T-cells, 90 kD; translational control protein 80 [Homo sapiens]
Transcript SEQ ID NO: 1253
Public Transcript Accession: NM_012218

Protein SEQ ID NO: 603
Public Protein Accession: Q9NRN4
Protein Name: Human NFAR-2 SEQ ID NO: 4
Transcript SEQ ID NO: 1254
Public Transcript Accession: AF167570

Protein SEQ ID NO: 604
Public Protein Accession: NP_703194.1
Protein Name: interleukin enhancer binding factor 3 isoform c; double-stranded RNA-binding protein, 76 kD; M-phase phosphoprotein 4; nuclear factor associated with dsRNA; nuclear factor of activated T-cells, 90 kD; translational control protein 80 [Homo sapiens]
Transcript SEQ ID NO: 1255
Public Transcript Accession: NM_153464

Protein SEQ ID NO: 605
Celera Protein: hCP1895438
Celera Gene: hCG2033721
OMIM number: 603182
OMIM Information: INTERLEUKIN ENHANCER-BINDING FACTOR 3;ILF3
Transcript SEQ ID NO: 1256
Celera Transcript: hCT2336766

Peptide SEQ ID NO: 1357 (202-210) Tissue AS210 , ratio = Singleton

======

Protein SEQ ID NO: 606
Celera Protein: hCP1895431
Celera Gene: hCG2033721
OMIM number: 603182
OMIM Information: INTERLEUKIN ENHANCER-BINDING FACTOR 3;ILF3
Transcript SEQ ID NO: 1257
Celera Transcript: hCT2336767

Peptide SEQ ID NO: 1357 (199-207) Tissue AS210 , ratio = Singleton

======

Protein SEQ ID NO: 607
Celera Protein: hCP1895435
Celera Gene: hCG2033721
OMIM number: 603182
OMIM Information: INTERLEUKIN ENHANCER-BINDING FACTOR 3;ILF3
Transcript SEQ ID NO: 1258
Celera Transcript: hCT2336772

Protein SEQ ID NO: 608
Celera Protein: hCP1895437
Celera Gene: hCG2033721
OMIM number: 603182
OMIM Information: INTERLEUKIN ENHANCER-BINDING FACTOR 3;ILF3
Transcript SEQ ID NO: 1259
Celera Transcript: hCT2336768

Protein SEQ ID NO: 609
Celera Protein: hCP1895432
Celera Gene: hCG2033721
OMIM number: 603182
OMIM Information: INTERLEUKIN ENHANCER-BINDING FACTOR 3;ILF3
Transcript SEQ ID NO: 1260
Celera Transcript: hCT2336769

Protein SEQ ID NO: 610
Celera Protein: hCP1895434
Celera Gene: hCG2033721
OMIM number: 603182
OMIM Information: INTERLEUKIN ENHANCER-BINDING FACTOR 3;ILF3
Transcript SEQ ID NO: 1261
Celera Transcript: hCT2336771

Peptide SEQ ID NO: 1357 (202-210) Tissue AS210 , ratio = Singleton

======

Protein SEQ ID NO: 611
Celera Protein: hCP1788047
Celera Gene: hCG1992389
Transcript SEQ ID NO: 1262
Celera Transcript: hCT2270943

Protein SEQ ID NO: 612
Celera Protein: hCP1788048
Celera Gene: hCG1992389
Transcript SEQ ID NO: 1263
Celera Transcript: hCT2270942

Peptide SEQ ID NO: 1497 (68-81) Tissue GW215 , ratio = Singleton

======

Protein SEQ ID NO: 613
Celera Protein: hCP1803876
Celera Gene: hCG1741566.1
Transcript SEQ ID NO: 1264
Celera Transcript: hCT2285938

Protein SEQ ID NO: 614
Celera Protein: hCP1701845.1
Celera Gene: hCG1741566.1
Transcript SEQ ID NO: 1265
Celera Transcript: hCT1779708.1

Peptide SEQ ID NO: 1497 (14-27) Tissue GW215 , ratio = Singleton

======

Protein SEQ ID NO: 615
Public Protein Accession: Q16658
Protein Name: Fascin (Singed-like protein) (55 kDa actin bundling protein) (p55)
Transcript SEQ ID NO: 1266
Public Transcript Accession: BC007948

Peptide SEQ ID NO: 1497 (67-80) Tissue GW215 , ratio = Singleton

======

Protein SEQ ID NO: 616
Celera Protein: hCP1788045
Celera Gene: hCG1992389
Transcript SEQ ID NO: 1267
Celera Transcript: hCT2270940

Peptide SEQ ID NO: 1497 (68-81) Tissue GW215 , ratio = Singleton

======

Protein SEQ ID NO: 617
Public Protein Accession: Q12907
Protein Name: Vesicular integral-membrane protein VIP36 precursor (GP36b glycoprotein)
Transcript SEQ ID NO: 1268
Public Transcript Accession: BC017263

Peptide SEQ ID NO: 1494 (195-206) Tissue AS210 , ratio = 2.3

======

Protein SEQ ID NO: 618
Celera Protein: hCP1888976.1
Celera Gene: hCG1981210.1
Transcript SEQ ID NO: 1269
Celera Transcript: hCT2253980.1

-continued

Peptide SEQ ID NO: 1494 (75-86) Tissue AS210 , ratio = 2.3

======

Protein SEQ ID NO: 619
Celera Protein: hCP1888972
Celera Gene: hCG1981210
Transcript SEQ ID NO: 1270
Celera Transcript: hCT2253978

Peptide SEQ ID NO: 1494 (195-206) Tissue AS210 , ratio = 2.3

======

Protein SEQ ID NO: 620
Public Protein Accession: NP_004175.1
Protein Name: tryptophanyl-tRNA synthetase; interferon-induced protein 53 [Homo sapiens]
Transcript SEQ ID NO: 1271
Public Transcript Accession: NM_004184

Protein SEQ ID NO: 621
Celera Protein: hCP1735492.1
Celera Gene: hCG25017.2
OMIM number: 191050
OMIM Information: TRYPTOPHANYL-tRNA SYNTHETASE;WARS
Transcript SEQ ID NO: 1272
Celera Transcript: hCT1824584.1

Protein SEQ ID NO: 622
Celera Protein: hCP1867985
Celera Gene: hCG25017.2
OMIM number: 191050
OMIM Information: TRYPTOPHANYL-tRNA SYNTHETASE;WARS
Transcript SEQ ID NO: 1273
Celera Transcript: hCT2329821

Protein SEQ ID NO: 623
Public Protein Accession: P23381
Protein Name: Tryptophanyl-tRNA synthetase (EC 6.1.1.2) (Tryptophan--tRNA ligase) (TrpRS) (IFP53) (hWRS)
Transcript SEQ ID NO: 1274
Public Transcript Accession: M77804

Protein SEQ ID NO: 624
Celera Protein: hCP41940.2
Celera Gene: hCG25017.2
OMIM number: 191050
OMIM Information: TRYPTOPHANYL-tRNA SYNTHETASE;WARS
Transcript SEQ ID NO: 1275
Celera Transcript: hCT16139.2

Protein SEQ ID NO: 625
Celera Protein: hCP1867980
Celera Gene: hCG25017.2
OMIM number: 191050
OMIM Information: TRYPTOPHANYL-tRNA SYNTHETASE;WARS
Transcript SEQ ID NO: 1276
Celera Transcript: hCT2329822

Protein SEQ ID NO: 626
Celera Protein: hCP1735510.1
Celera Gene: hCG25017.2
OMIM number: 191050
OMIM Information: TRYPTOPHANYL-tRNA SYNTHETASE;WARS
Transcript SEQ ID NO: 1277
Celera Transcript: hCT1824585.1

Protein SEQ ID NO: 627
Celera Protein: hCP1867986
Celera Gene: hCG25017.2
OMIM number: 191050
OMIM Information: TRYPTOPHANYL-tRNA SYNTHETASE;WARS
Transcript SEQ ID NO: 1278
Celera Transcript: hCT2329820

Peptide SEQ ID NO: 1369 (220-230) Tissue GW215 , ratio = Singleton

======

Protein SEQ ID NO: 628
Celera Protein: hCP50405.2

-continued

Celera Gene: hCG40675.2
OMIM number: 147558
OMIM Information: INTEGRIN, BETA-6;ITGB6
Transcript SEQ ID NO: 1279
Celera Transcript: hCT31936.2

Peptide SEQ ID NO: 1379 (9-31) Tissue AS210 , ratio = 3.4

======

Protein SEQ ID NO: 629
Celera Protein: hCP34289.3
Celera Gene: hCG16855.3
Transcript SEQ ID NO: 1280
Celera Transcript: hCT7897.3

Peptide SEQ ID NO: 1361 (601-611) Tissue GW215 , ratio = Singleton

======

Protein SEQ ID NO: 630
Public Protein Accession: Q06210
Protein Name: Glucosamine--fructose-6-phosphate aminotransferase [isomerizing] 1 (EC 2.6.1.16) (Hexosephosphate aminotransferase 1) (D-fructose-6-phosphate amidotransferase 1) (GFAT 1) (GFAT1)

Peptide SEQ ID NO: 1361 (618-628) Tissue GW215 , ratio = Singleton

======

Protein SEQ ID NO: 631
Celera Protein: hCP50924.1
Celera Gene: hCG41100.2
OMIM number: 153620
OMIM Information: MACROPHAGE MIGRATION INHIBITORY FACTOR;MIF
Transcript SEQ ID NO: 1281
Celera Transcript: hCT32370.2

Peptide SEQ ID NO: 1436 (78-86) Tissue AS210 , ratio = Singleton

======

Protein SEQ ID NO: 632
Public Protein Accession: P14174
Protein Name: Human macrophage migration inhibitory factor, MIF
Transcript SEQ ID NO: 1282
Public Transcript Accession: AF469046

Peptide SEQ ID NO: 1436 (77-85) Tissue AS210 , ratio = Singleton

======

Protein SEQ ID NO: 633
Public Protein Accession: NP_002406.1
Protein Name: macrophage migration inhibitory factor (glycosylation-inhibiting factor); glycosylation-inhibiting factor; phenylpyruvate tautomerase [Homo sapiens]
Transcript SEQ ID NO: 1283
Public Transcript Accession: NM_002415

Peptide SEQ ID NO: 1436 (78-86) Tissue AS210 , ratio = Singleton

======

Protein SEQ ID NO: 634
Public Protein Accession: Q14315
Protein Name: Filamin C (Gamma-filamin) (Filamin 2) (Protein FLNc) (Actin-binding like protein) (ABP-L) (ABP-280-like protein)

Peptide SEQ ID NO: 1411 (615-628) Tissue GW215 , ratio = Singleton

======

Protein SEQ ID NO: 635
Public Protein Accession: NP_001449.1
Protein Name: Gamma-filamin (Filamin 2)
Transcript SEQ ID NO: 1284
Public Transcript Accession: NM_001458

Peptide SEQ ID NO: 1411 (595-608) Tissue GW215 , ratio = Singleton

======

-continued

Protein SEQ ID NO: 636
Celera Protein: hCP51518.2
Celera Gene: hCG41655.4
OMIM number: 102565
OMIM Information: FILAMIN C;FLNC
Transcript SEQ ID NO: 1285
Celera Transcript: hCT32927.3

Peptide SEQ ID NO: 1411 (615-628) Tissue GW215 , ratio = Singleton

======

Protein SEQ ID NO: 637
Celera Protein: hCP1909611
Celera Gene: hCG2039620
OMIM number: 100650
OMIM Information: ALDEHYDE DEHYDROGENASE 2;ALDH2
Transcript SEQ ID NO: 1286
Celera Transcript: hCT2344314

Peptide SEQ ID NO: 1435 (67-77) Tissue AS210 , ratio = Singleton

======

Protein SEQ ID NO: 638
Public Protein Accession: P05091
Protein Name: Aldehyde dehydrogenase, mitochondrial precursor (EC 1.2.1.3) (ALDH class 2) (ALDHI) (ALDH-E2)
Transcript SEQ ID NO: 1287
Public Transcript Accession: BC002967

Peptide SEQ ID NO: 1435 (383-393) Tissue AS210 , ratio = Singleton

======

Protein SEQ ID NO: 639
Celera Protein: hCP1881217.1
Celera Gene: hCG2039620
OMIM number: 100650
OMIM Information: ALDEHYDE DEHYDROGENASE 2;ALDH2
Transcript SEQ ID NO: 1288
Celera Transcript: hCT2309105.1

Peptide SEQ ID NO: 1435 (288-298) Tissue AS210 , ratio = Singleton

======

Protein SEQ ID NO: 640
Celera Protein: hCP1881216
Celera Gene: hCG2016298
OMIM number: 100650
OMIM Information: ALDEHYDE DEHYDROGENASE 2;ALDH2
Transcript SEQ ID NO: 1289
Celera Transcript: hCT2309107

Peptide SEQ ID NO: 1435 (383-393) Tissue AS210 , ratio = Singleton

======

Protein SEQ ID NO: 641
Celera Protein: hCP49877.3
Celera Gene: hCG40106.3
OMIM number: 180470
OMIM Information: RIBOPHORIN I;RPN1
Transcript SEQ ID NO: 1290
Celera Transcript: hCT31360.3

Protein SEQ ID NO: 642
Public Protein Accession: P04843
Protein Name: Dolichyl-diphosphooligosaccharide--protein glycosyltransferase 67 kDa subunit precursor (EC 2.4.1.119) (Ribophorin I) (RPN-I)
Transcript SEQ ID NO: 1291
Public Transcript Accession: BC010839

Protein SEQ ID NO: 643
Celera Protein: hCP1786031
Celera Gene: hCG40106.3
OMIM number: 180470
OMIM Information: RIBOPHORIN I;RPN1
Transcript SEQ ID NO: 1292
Celera Transcript: hCT2319191

-continued

Peptide SEQ ID NO: 1433 (536-546) Tissue AS210 , ratio = Singleton

======

Protein SEQ ID NO: 644
Celera Protein: hCP1777633.1
Celera Gene: hCG40714.4
OMIM number: 179509
OMIM Information: RAS-ASSOCIATED PROTEIN RAB2;RAB2
Transcript SEQ ID NO: 1293
Celera Transcript: hCT1962773.1

Protein SEQ ID NO: 645
Public Protein Accession: P08886
Protein Name: Protein with cell signal transmission activity analogous to human YPT-1
Transcript SEQ ID NO: 1294
Public Transcript Accession: AF498930

Protein SEQ ID NO: 646
Celera Protein: hCP1764551.1
Celera Gene: hCG41224.3
Transcript SEQ ID NO: 1295
Celera Transcript: hCT1957515.1

Protein SEQ ID NO: 647
Celera Protein: hCP50462.2
Celera Gene: hCG40714.4
OMIM number: 179509
OMIM Information: RAS-ASSOCIATED PROTEIN RAB2;RAB2
Transcript SEQ ID NO: 1296
Celera Transcript: hCT31975.4

Peptide SEQ ID NO: 1459 (19-29) Tissue AS210 , ratio = Singleton

======

Protein SEQ ID NO: 648
Celera Protein: hCP1764590.1
Celera Gene: hCG41224.3
Transcript SEQ ID NO: 1297
Celera Transcript: hCT1957516.1

Peptide SEQ ID NO: 1459 (78-88) Tissue AS210 , ratio = Singleton

======

Protein SEQ ID NO: 649
Celera Protein: hCP51148.2
Celera Gene: hCG41224.3
Transcript SEQ ID NO: 1298
Celera Transcript: hCT32494.2

Protein SEQ ID NO: 650
Public Protein Accession: NP_116235.2 Q8WUD1
Protein Name: Amino acid sequence of human RAB2B, an isoform of RAB2A
Transcript SEQ ID NO: 1299
Public Transcript Accession: NM_032846

Peptide SEQ ID NO: 1459 (19-29) Tissue AS210 , ratio = Singleton

======

Protein SEQ ID NO: 651
Celera Protein: hCP51395.2
Celera Gene: hCG41512.3
OMIM number: 182380
OMIM Information: SOLUTE CARRIER FAMILY 5, MEMBER 1;SLC5A1
Transcript SEQ ID NO: 1300
Celera Transcript: hCT32782.2

Protein SEQ ID NO: 652
Public Protein Accession: P13866
Protein Name: Sodium/glucose cotransporter 1 (Na(+)/glucose cotransporter 1) (High affinity sodium-glucose cotransporter)
Transcript SEQ ID NO: 1301
Public Transcript Accession: M24847

Peptide SEQ ID NO: 1394 (311-320) Tissue AS210 , ratio = 5.0

======

-continued

Protein SEQ ID NO: 653
Celera Protein: hCP1784169.1
Celera Gene: hCG1820593.2
OMIM number: 140550
OMIM Information: HEAT-SHOCK 70-KD PROTEIN 1A;HSPA1A
Transcript SEQ ID NO: 1302
Celera Transcript: hCT1970824.2

Peptide SEQ ID NO: 1343 (299-310) Tissue AS210 , ratio = Singleton

======

Protein SEQ ID NO: 654
Public Protein Accession: NP_002146.1 P17066
Protein Name: Human schizophrenia/SCZ associated protein HSP70B SEQ ID NO 2
Transcript SEQ ID NO: 1303
Public Transcript Accession: NM_002155

Peptide SEQ ID NO: 1343 (301-312) Tissue AS210 , ratio = Singleton

======

Protein SEQ ID NO: 655
Celera Protein: hCP52114.2
Celera Gene: hCG43726.3
OMIM number: 603012
OMIM Information: HEAT-SHOCK 70-KD PROTEIN 1B;HSPA1B
Transcript SEQ ID NO: 1304
Celera Transcript: hCT35011.3

Peptide SEQ ID NO: 1343 (299-310) Tissue AS210 , ratio = Singleton

======

Protein SEQ ID NO: 656
Public Protein Accession: P17066
Protein Name: Heat shock 70 kDa protein 6 (Heat shock 70 kDa protein B')
Transcript SEQ ID NO: 1305
Public Transcript Accession: BC035665

Peptide SEQ ID NO: 1343 (301-312) Tissue AS210 , ratio = Singleton

======

Protein SEQ ID NO: 657
Public Protein Accession: NP_005337.1
Protein Name: heat shock 70kDa protein 1B; heat shock 70kD protein 1B [Homo sapiens]
Transcript SEQ ID NO: 1306
Public Transcript Accession: NM_005346

Protein SEQ ID NO: 658
Public Protein Accession: P08107
Protein Name: Human Hsp70 family homologue, Hsp71
Transcript SEQ ID NO: 1307
Public Transcript Accession: BC002453

Peptide SEQ ID NO: 1343 (299-310) Tissue AS210 , ratio = Singleton

======

Protein SEQ ID NO: 659
Celera Protein: hCP1907403
Celera Gene: hCG2036699
Transcript SEQ ID NO: 1308
Celera Transcript: hCT2340819

Peptide SEQ ID NO: 1343 (301-312) Tissue AS210 , ratio = Singleton

======

Protein SEQ ID NO: 660
Celera Protein: hCP1852372
Celera Gene: hCG2032701
OMIM number: 601134
OMIM Information: INTEGRAL MEMBRANE PROTEIN 1;ITM1
Transcript SEQ ID NO: 1309
Celera Transcript: hCT2335133

Protein SEQ ID NO: 661
Public Protein Accession: P46977

Protein Name: Oligosaccharyl transferase STT3 subunit homolog (B5) (Integral membrane protein 1) (TMC)
Transcript SEQ ID NO: 1310
Public Transcript Accession: L38961

Protein SEQ ID NO: 662
Celera Protein: hCP1852370
Celera Gene: hCG2032701
OMIM number: 601134
OMIM Information: INTEGRAL MEMBRANE PROTEIN 1;ITM1
Transcript SEQ ID NO: 1311
Celera Transcript: hCT2335135

Protein SEQ ID NO: 663
Celera Protein: hCP1852366
Celera Gene: hCG2032701
OMIM number: 601134
OMIM Information: INTEGRAL MEMBRANE PROTEIN 1;ITM1
Transcript SEQ ID NO: 1312
Celera Transcript: hCT2335134

Peptide SEQ ID NO: 1375 (628-640) Tissue AS210 , ratio = Singleton

======

Protein SEQ ID NO: 664
Celera Protein: hCP1765599
Celera Gene: hCG38871.3
OMIM number: 602202
OMIM Information: DOLICHYL-DIPHOSPHOOLIGOSACCHARIDE-PROTEIN GLYCOSYLTRANSFERASE;DDOST
Transcript SEQ ID NO: 1313
Celera Transcript: hCT1955780.1

Protein SEQ ID NO: 665
Public Protein Accession: P39656
Protein Name: Dolichyl-diphosphooligosaccharide--protein glycosyltransferase 48 kDa subunit precursor (EC 2.4.1.119) (Oligosaccharyl transferase 48 kDa subunit) (DDOST 48 kDa subunit)
Transcript SEQ ID NO: 1314
Public Transcript Accession: D29643

Protein SEQ ID NO: 666
Celera Protein: hCP1855094
Celera Gene: hCG38871.3
OMIM number: 602202
OMIM Information: DOLICHYL-DIPHOSPHOOLIGOSACCHARIDE-PROTEIN GLYCOSYLTRANSFERASE;DDOST
Transcript SEQ ID NO: 1315
Celera Transcript: hCT2258547

Protein SEQ ID NO: 667
Celera Protein: hCP48742
Celera Gene: hCG38871.3
OMIM number: 602202
OMIM Information: DOLICHYL-DIPHOSPHOOLIGOSACCHARIDE-PROTEIN GLYCOSYLTRANSFERASE;DDOST
Transcript SEQ ID NO: 1316
Celera Transcript: hCT30117.3

Peptide SEQ ID NO: 1377 (139-152) Tissue NS216 , ratio = 3.1

======

Protein SEQ ID NO: 668
Celera Protein: hCP43332.2
Celera Gene: hCG27781.3
Transcript SEQ ID NO: 1317
Celera Transcript: hCT18923.3

Protein SEQ ID NO: 669
Celera Protein: hCP1881417
Celera Gene: hCG27781.3
Transcript SEQ ID NO: 1318
Celera Transcript: hCT2308866

Protein SEQ ID NO: 670
Celera Protein: hCP1881416
Celera Gene: hCG27781.3
Transcript SEQ ID NO: 1319
Celera Transcript: hCT2308865

Peptide SEQ ID NO: 1498 (37-47) Tissue GW215 , ratio = Singleton

======

Protein SEQ ID NO: 671
Public Protein Accession: XP_045792.7
Protein Name: GCN1 general control of amino-acid synthesis 1-like 1 [Homo sapiens]
Transcript SEQ ID NO: 1320
Public Transcript Accession: XM_045792

Peptide SEQ ID NO: 1498 (240-250) Tissue GW215 , ratio = Singleton

======

Protein SEQ ID NO: 672
Celera Protein: hCP1881415
Celera Gene: hCG27781.3
Transcript SEQ ID NO: 1321
Celera Transcript: hCT2308867

Peptide SEQ ID NO: 1498 (37-47) Tissue GW215 , ratio = Singleton

======

Protein SEQ ID NO: 673
Celera Protein: hCP50637.2
Celera Gene: hCG40851.2
OMIM number: 153340
OMIM Information: LYMPHOCYTE ANTIGEN CD5;CD5
Transcript SEQ ID NO: 1322
Celera Transcript: hCT32118.2

Protein SEQ ID NO: 674
Public Protein Accession: P06127
Protein Name: T-cell surface glycoprotein CD5 precursor (Lymphocyte glycoprotein T1/Leu-1) (Lymphocyte antigen CD5)
Transcript SEQ ID NO: 1323
Public Transcript Accession: X04391

Peptide SEQ ID NO: 1420 (238-251) Tissue AS210 , ratio = >3.8

======

Protein SEQ ID NO: 675
Celera Protein: hCP51336.2
Celera Gene: hCG41454.3
OMIM number: 160775
OMIM Information: MYOSIN, HEAVY CHAIN 9, NONMUSCLE;MYH9
Transcript SEQ ID NO: 1324
Celera Transcript: hCT32725.3

Protein SEQ ID NO: 676
Celera Protein: hCP1797739
Celera Gene: hCG41454.3
OMIM number: 160775
OMIM Information: MYOSIN, HEAVY CHAIN 9, NONMUSCLE;MYH9
Transcript SEQ ID NO: 1325
Celera Transcript: hCT2301111

Protein SEQ ID NO: 677
Public Protein Accession: P35579
Protein Name: Human protein SEQ ID NO 1516

Protein SEQ ID NO: 678
Celera Protein: hCP1797738
Celera Gene: hCG41454.3
OMIM number: 160775
OMIM Information: MYOSIN, HEAVY CHAIN 9, NONMUSCLE;MYH9
Transcript SEQ ID NO: 1326
Celera Transcript: hCT2301109

Peptide SEQ ID NO: 1426 (1371-1387) Tissue AS210 , ratio = Singleton

======

Protein SEQ ID NO: 679
Public Protein Accession: P08246
Protein Name: Sequence of serine protease (SP) of human myeloid cell origin and leader peptide
Transcript SEQ ID NO: 1327
Public Transcript Accession: X05875

Protein SEQ ID NO: 680
Celera Protein: hCP39107.2
Celera Gene: hCG21580.2

OMIM number: 130130
OMIM Information: ELASTASE 2;ELA2
Transcript SEQ ID NO: 1328
Celera Transcript: hCT12671.2

Peptide SEQ ID NO: 1431 (144-160) Tissue AS210 , ratio = 9.2

======

Protein SEQ ID NO: 681
Celera Protein: hCP41672.2
Celera Gene: hCG24460.3
OMIM number: 605139
OMIM Information: CHAPERONIN CONTAINING T-COMPLEX POLYPEPTIDE 1, SUBUNIT 2;CCT2
Transcript SEQ ID NO: 1329
Celera Transcript: hCT15577.3

Protein SEQ ID NO: 682
Public Protein Accession: P78371
Protein Name: Human secreted protein sequence encoded by gene 35 SEQ ID NO:146
Transcript SEQ ID NO: 1330
Public Transcript Accession: AF026293

Peptide SEQ ID NO: 1468 (388-401) Tissue AS210 , ratio = Singleton

======

Protein SEQ ID NO: 683
Celera Protein: hCP1763503.1
Celera Gene: hCG24460.3
OMIM number: 605139
OMIM Information: CHAPERONIN CONTAINING T-COMPLEX POLYPEPTIDE 1, SUBUNIT 2;CCT2
Transcript SEQ ID NO: 1331
Celera Transcript: hCT1951648.1

Peptide SEQ ID NO: 1468 (341-354) Tissue AS210 , ratio = Singleton

======

SEQUENCE LISTING (1501 sequences)

SEQ ID NO: 1 - protein, 193 aa, Homo sapiens
MAAIRKKLVIVGDGACGKTCLLIVFSKDQFPEVYVPTVFENYVADIEVDGKQVELALWDTAGQEDYDRLRPLSYPDTDVILMCFSIDSPDSLENIPEKWTPEVKHFCPNVPIILVGNKKDLRNDEHTRRELAKMKQEPVKPEEGRDMANRIGAFGYMECSAKTKDGVREVFEMATRAALQARRGKKKSGCLVL

SEQ ID NO: 2 - protein, 193 aa, Homo sapiens; identical to SEQ ID NO: 1

SEQ ID NO: 3 - protein, 279 aa, Homo sapiens
MATIGVTRGLGDHSLKVCSSTLPIKPFLSCFPEVRVYDLTQYEHCPDDVLVLGTDGLWDVTTDCEVAATVDRVLSAYEPNDHSSPTMAAIRKKLVIVGDGACGKTCLLIVFSKDQFPEVYVPTVFENYIADIEVDGKQVELALWDTAGQEDYDRLRPLSYPDTDVILMCFSIDSPDSLENIPEKWTPEVKHFCPNVPIILVGNKKDLRQDEHTRRELAKMKQEPVRSEEGRDMANRISAFGYLECSAKTKEGVREVFEMATRAGLQVRKNKRRRGCPIL

SEQ ID NO: 4 - protein, 193 aa, Homo sapiens; identical to SEQ ID NO: 1

SEQ ID NO: 5 - protein, 193 aa, Homo sapiens; identical to SEQ ID NO: 1

SEQ ID NO: 6 - protein, 193 aa, Homo sapiens
MAAIRKKLVIVGDGACGKTCLLIVFSKDQFPEVYVPTVFENYIADIEVDGKQVELALWDTAGQEDYDRLRPLSYPDTDVILMCFSIDSPDSLENIPEKWTPEVKHFCPNVPIILVGNKKDLRQDEHTRRELAKMKQEPVRSEEGRDMANRISAFGYLECSAKTKEGVREVFEMATRAGLQVRKNKRRRGCPIL

SEQ ID NO: 7 - protein, 230 aa, Homo sapiens
MVSISGGDLPTGLDFISAPEPALSSCSLGTSAGWSPTMAAIRKKLVIVGDGACGKTCLLIVFSKDQFPEVYVPTVFENYIADIEVDGKQVELALWDTAGQEDYDRLRPLSYPDTDVILMCFSIDSPDSLENIPEKWTPEVKHFCPNVPIILVGNKKDLRQDEHTRRELAKMKQEPVRSEEGRDMANRISAFGYLECSAKTKEGVREVFEMATRAGLQVRKNKRRRGCPIL

SEQ ID NO: 8 - protein, 384 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKVSTSSTTKSPASSASGPRPTYKPPVSNYPGYPKPEEGILDSLDVWVIAVIVIAIVVGVAVICVVPYRYLQRRKKKGKADGGAEYATYQTKSTTPAEQRG

SEQ ID NO: 9 - protein, 392 aa, Homo sapiens [sequence omitted]

SEQ ID NO: 10 - protein, 399 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKVLPPSSTKPPALSHSVSTSSTTKSPASSASGPRPTYKPPVSNYPGYPKPEEGILDSLDVWVIAVIVIAIVVGVAVICVVPYRYLQRRKKKGKADGGAEYATYQTKSTTPAEQRG

SEQ ID NO: 11 - protein, 362 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKGPRPTYKPPVSNYPGYPKPEEGILDSLDVWVIAVIVIAIVVGVAVICVVPYRYLQRRKKKGTYLTDETHREVKFTSL

SEQ ID NO: 12 - protein, 369 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKGPRPTYKPPVSNYPGYPKPEEGILDSLDVWVIAVIVIAIVVGVAVICVVPYRYLQRRKKKGKADGGAEYATYQTKSTTPAEQRG

SEQ ID NO: 13 - protein, 377 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKVSTSSTTKSPASSASGPRPTYKPPVSNYPGYPKPEEGILDSLDVWVIAVIVIAIVVGVAVICVVPYRYLQRRKKKGTYLTDETHREVKFTSL

SEQ ID NO: 14 - protein, 370 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKVSTSSTTKSPASSASGYPKPEEGILDSLDVWVIAVIVIAIVVGVAVICVVPYRYLQRRKKKGKADGGAEYATYQTKSTTPAEQRG

SEQ ID NO: 15 - protein, 373 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKVSTSSTTKSPASSASGPRPTYKPPVSNYPGYPKPEEGILDSLDVWVIAVIVIAIDIFKGGRRKGKQMVELNMPLTRLNQPLQQSREAE

SEQ ID NO: 16 - protein, 349 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKGPRPTYKPPVSNYPGYPKPEEGILDSLDVWVIAVIVIAIGKQMVELNMPLTRLNQPLQQSREAE

SEQ ID NO: 17 - protein, 377 aa, Homo sapiens; identical to SEQ ID NO: 13

SEQ ID NO: 18 - protein, 378 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKVLPPSSTKPPALSHSVSTSSTTKSPASSASGYPKPEEGILDSLDVWVIAVIVIAIVVGVAVICVVPYRYLQRRKKKGTYLTDETHREVKFTSL

SEQ ID NO: 19 - protein, 385 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKVLPPSSTKPPALSHSVSTSSTTKSPASSASGYPKPEEGILDSLDVWVIAVIVIAIVVGVAVICVVPYRYLQRRKKKGKADGGAEYATYQTKSTTPAEQRG

SEQ ID NO: 20 - protein, 363 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKVSTSSTTKSPASSASGYPKPEEGILDSLDVWVIAVIVIAIVVGVAVICVVPYRYLQRRKKKGTYLTDETHREVKFTSL

SEQ ID NO: 21 - protein, 355 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKGYPKPEEGILDSLDVWVIAVIVIAIVVGVAVICVVPYRYLQRRKKKGKADGGAEYATYQTKSTTPAEQRG

SEQ ID NO: 22 - protein, 348 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKGYPKPEEGILDSLDVWVIAVIVIAIVVGVAVICVVPYRYLQRRKKKGTYLTDETHREVKFTSL

SEQ ID NO: 23 - protein, 478 aa, Homo sapiens
MAPLRPLLILALLAWVALADQESCKGRCTEGFNVDKKCQCDELCSYYQSCCTDYTAECKPQVTRGDVFTMPEDEYTVYDDGEEKNNATVHEQVGGPSLTSDLQAQSKGNPEQTPVLKPEEEAPAPEVGASKPEGIDSRPETLHPGRPQPPAEEELCSGKPFDAFTDLKNGSLFAFRGQYCYELDEKAVRPGYPKLIRDVWGIEGPIDAAFTRINCQGKTYLFKGSQYWRFEDGVLDPDYPRNISDGFDGIPDNVDAALALPAHSYSGRERVYFFKGKQYWEYQFQHQPSQEECEGSSLSAVFEHFAMMQRDSWEDIFELLFWGRTSAGTRQPQFISRDWHGVPGQVDAAMAGRIYISGMAPRPSLAKKQRFRHRNRKGYRSQRGHSRGRNQNSRRPSRATWLSLFSSEESNLGANNYDDYRMDWLVPATCEPIQSVFFFSGDKYYRVNLRTRRVDTVDPPYPRSIAQYWLGCPAPGHL

SEQ ID NO: 24 - protein, 478 aa, Homo sapiens
MAPLRPLLILALLAWVALADQESCKGRCTEGFNVDKKCQCDELCSYYQSCCTDYTAECKPQVTRGDVFTMPEDEYTVYDDGEEKNNATVHEQVGGPSLTSDLQAQSKGNPEQTPVLKPEEEAPAPEVGASKPEGIDSRPETLHPGRPQPPAEEELCSGKPFDAFTDLKNGSLFAFRGQYCYELDEKAVRPGYPKLIRDVWGIEGPIDAAFTRINCQGKTYLFKGSQYWRFEDGVLDPDYPRNISDGFDGIPDNVDAALALPAHSYSGRERVYFFKGKQYWEYQFQHQPSQEECEGSSLSAVFEHFAMMQRDSWEDIFELLFWGRTSAGTRQPQFISRDWHGVPGQVDAAMAGRIYISGMAPRPSLAKKQRFRHRNRKGYRSQRGHSRGRNQNSRRPSRAMWLSLFSSEESNLGANNYDDYRMDWLVPATCEPIQSVFFFSGDKYYRVNLRTRRVDTVDPPYPRSIAQYWLGCPAPGHL

SEQ ID NO: 25 - protein, 33 aa, Homo sapiens
MLLLILLRDESHFTKIKLCFSAKMMIQVEDTSL

SEQ ID NO: 26 - protein, 1181 aa, Homo sapiens
MGPERTGAAPLPLLLVLALSQGILNCCLAYNVGLPEAKIFSGPSSEQFGYAVQQFINPKGNWLLVGSPWSGFPENRMGDVYKCPVDLSTATCEKLNLQTSTSIPNVTEMKTNMSLGLILTRNMGTGGFLTCGPLWAQQCGNQYYTTGVCSDISPDFQLSASFSPATQPCPSLIDVVVVCDESNSIYPWDAVKNFLEKFVQGLDIGPTKTQVGLIQYANNPRVVFNLNTYKTKEEMIVATSQTSQYGGDLTNTFGAIQYARKYAYSAASGGRRSATKVMVVVTDGESHDGSMLKAVIDQCNHDNILRFGIAVLGYLNRNALDTKNLIKEIKAIASIPTERYFFNVSDEAALLEKAGTLGEQIFSIEGTVQGGDNFQMEMSQVGFSADYSSQNDILMLGAVGAFGWSGTIVQKTSHGHLIFPKQAFDQILQDRNHSSYLGYSVAAISTGESTHFVAGAPRANYTGQIVLYSVNENGNITVIQAHRGDQIGSYFGSVLCSVDVDKDTITDVLLVGAPMYMSDLKKEEGRVYLFTIKKGILGQHQFLEGPEGIENTRFGSAIAALSDINMDGFNDVIVGSPLENQNSGAVYIYNGHQGTIRTKYSQKILGSDGAFRSHLQYFGRSLDGYGDLNGDSITDVSIGAFGQVVQLWSQSIADVAIEASFTPEKITLVNKNAQIILKLCFSAKFRPTKQNNQVAIVYNITLDADGFSSRVTSRGLFKENNERCLQKNMVVNQAQSCPEHIIYIQEPSDVVNSLDLRVDISLENPGTSPALEAYSETAKVFSIPFHKDCGEDGLCISDLVLDVRQIPAAQEQPFIVSNQNKRLTFSVTLKNKRESAYNTGIVVDFSENLFFASFSLPVDGTEVTCQVAASQKSVACDVGYPALKREQQVTFTINFDFNLQNLQNQASLSFQALSESQEENKADNLVNLKIPLLYDAEIHLTRSTNINFYEISSDGNVPSIVHSFEDVGPKFIFSLKVTTGSVPVSMATVIIHIPQYTKEKNPLMYLTGVQTDKAGDISCNADINPLKIGQTSSSVSFKSENFRHTKELNCRTASCSNVTCWLKDVHMKGEYFVNVTTRIWNGTFASSTFQTVQLTAAAEINTYNPEIYVIEDNTVTIPLMIMKPDEKAEVPTGVIIGSIIAGILLLLALVAILWKLGFFKRKYEKMTKNPDEIDETTELSS

SEQ ID NO: 27 - protein, 1181 aa, Homo sapiens
MGPERTGAAPLPLLLVLALSQGILNCCLAYNVGLPEAKIFSGPSSEQFGYAVQQFINPKGNWLLVGSPWSGFPENRMGDVYKCPVDLSTATCEKLNLQTSTSIPNVTEMKTNMSLGLILTRNMGTGGFLTCGPLWAQQCGNQYYTTGVCSDISPDFQLSASFSPATQPCPSLIDVVVVCDESNSIYPWDAVKNFLEKFVQGLDIGPTKTQVGLIQYANNPRVVFNLNTYKTKEEMIVATSQTSQYGGDLTNTFGAIQYARKYAYSAASGGRRSATKVMVVVTDGESHDGSMLKAVIDQCNHDNILRFGIAVLGYLNRNALDTKNLIKEIKAIASIPTERYFFNVSDEAALLEKAGTLGEQIFSIEGTVQGGDNFQMEMSQVGFSADYSSQNDILMLGAVGAFGWSGTIVQKTSHGHLIFPKQAFDQILQDRNHSSYLGYSVAAISTGESTHFVAGAPRANYTGQIVLYSVNENGNITVIQAHRGDQIGSYFGSVLCSVDVDKDTITDVLLVGAPMYMSDLKKEEGRVYLFTIKEGILGQHQFLEGPEGIENTRFGSAIAALSDINMDGFNDVIVGSPLENQNSGAVYIYNGHQGTIRTKYSQKILGSDGAFRSHLQYFGRSLDGYGDLNGDSITDVSIGAFGQVVQLWSQSIADVAIEASFTPEKITLVNKNAQIILKLCFSAKFRPTKQNNQVAIVYNITLDADGFSSRVTSRGLFKENNERCLQKNMVVNQAQSCPEHIIYIQEPSDVVNSLDLRVDISLENPGTSPALEAYSETAKVFSIPFHKDCGEDGLCISDLVLDVRQIPAAQEQPFIVSNQNKRLTFSVTLKNKRESAYNTGIVVDFSENLFFASFSLPVDGTEVTCQVAASQKSVACDVGYPALKREQQVTFTINFDFNLQNLQNQASLSFQALSESQEENKADNLVNLKIPLLYDAEIHLTRSTNINFYEISSDGNVPSIVHSFEDVGPKFIFSLKVTTGSVPVSMATVIIHIPQYTKEKNPLMYLTGVQTDKAGDISCNADINPLKIGQTSSSVSFKSENFRHTKELNCRTASCSNVTCWLKDVHMKGEYFVNVTTRIWNGTFASSTFQTVQLTAAAEINTYNPEIYVIEDNTVTIPLMIMKPDEKAEVPTGVIIGSIIAGILLLLALVAILWKLGFFKRKYEKMTKNPDEIDETTELSS

SEQ ID NO: 28 - protein, 33 aa, Homo sapiens; identical to SEQ ID NO: 25

SEQ ID NO: 29 - protein, 33 aa, Homo sapiens; identical to SEQ ID NO: 25

SEQ ID NO: 30 - protein, 33 aa, Homo sapiens; identical to SEQ ID NO: 25

SEQ ID NO: 31 - protein, 33 aa, Homo sapiens; identical to SEQ ID NO: 25

SEQ ID NO: 32 - protein, 33 aa, Homo sapiens; identical to SEQ ID NO: 25

SEQ ID NO: 33 - protein, 33 aa, Homo sapiens; identical to SEQ ID NO: 25

SEQ ID NO: 34 - protein, 33 aa, Homo sapiens; identical to SEQ ID NO: 25

SEQ ID NO: 35 - protein, 1179 aa, Homo sapiens
MGPERTGAAPLPLLLVLALSQGILNCCLAYNVGLPEAKIFSGPSSEQFGYAVQQFINPKGNWLLVGSPWSGFPENRMGDVYKCPVDLSTATCEKLNLQTSTSIPNVTEMKTNMSLGLILTRNMGTGGFLTCGPLWAQQCGNQYYTTGVCSDISPDFQLSASFSPATQPCPSLIDVVVVCDESNSIYPWDAVKNFLEKFVQGLDIGPTKTQVGLIQYANNPRVVFNLNTYKTKEEMIVATSQTSQYGGDLTNTFGAIQYARKYAYSAASGGRRSATKVMVVVTDGESHDGSMLKAVIDQCNHDNILRFGIAVLGYLNRNALDTKNLIKEIKAIASIPTERYFFNVSDEAALLEKAGTLGEQIFSIEGTVQGGDNFQMEMSQVGFSADYSSQNDILMLGAVGAFGWSGTIVQKTSHGHLIFPKQAFDQILQDRNHSSYLGYSVAAISTGESTHFVAGAPRANYTGQIVLYSVNENGNITVIQAHRGDQIGSYFGSVLCSVDVDKDTITDVLLVGAPMYMSDLKKEEGRVYLFTIKEGILGQHQFLEGPEGIENTRFGSAIAALSDINMDGFNDVIVGSPLENQNSGAVYIYNGHQGTIRTKYSQKILGSDGAFRSHLQYFGRSLDGYGDLNGDSITDVSIGAFGQVVQLWSQSIADVAIEASFTPEKITLVNKNAQIILKLCFSAKFRPTKQNNQVAIVYNITLDADGFSSRVTSRGLFKENNERCLQKNMVVNQAQSCPEHIIYIQEPSDVVNSLDLRVDISLENPGTSPALEAYSETAKVFSIPFHKDCGEDGLCISDLVLDVRQIPAAQEQPFIVSNQNKRLTFSVTLKNKRESAYNTGIVVDFSENLFFASFSLPVDGTEVTCQVAASQKSVACDVGYPALKREQQVTFTINFDFNLQNLQNQASLSFQALSESQEENKADNLVNLKIPLLYDAEIHLTRSTNINFYEISSDGNVPSIVHSFEDVGPKFIFSLKVGSVPVSMATVIIHIPQYTKEKNPLMYLTGVQTDKAGDISCNADINPLKIGQTSSSVSFKSENFRHTKELNCRTASCSNVTCWLKDVHMKGEYFVNVTTRIWNGTFASSTFQTVQLTAAAEINTYNPEIYVIEDNTVTIPLMIMKPDEKAEVPTGVIIGSIIAGILLLLALVAILWKLGFFKRKYEKMTKNPDEIDETTELSS

SEQ ID NO: 36 - protein, 33 aa, Homo sapiens; identical to SEQ ID NO: 25

SEQ ID NO: 37 - protein, 33 aa, Homo sapiens; identical to SEQ ID NO: 25

SEQ ID NO: 38 - protein, 1179 aa, Homo sapiens
MAACGRVRRMFRLSAALHLLLLFAAGAEKLPGQGVHSQGQGPGANFVSFVGQAGGGGPAGQQLPQLPQSSQLQQQQQQQQQQQQPQPPQPPFPAGGPPARRGGAGAGGGWKLAEEESCREDVTRVCPKHTWSNNLAVLECLQDVREPENEISSDCNHLLWNYKLNLTTDPKFESVAREVCKSTITEIKECADEPVGKGYMVSCLVDHRGNITEYQCHQYITKMTAIIFSDYRLICGFMDDCKNDINILKCGSIRLGEKDAHSQGEVVSCLEKGLVKEAEEREPKIQVSELCKKAILRVAELSSDDFHLDRHLYFACRDDRERFCENTQAGEGRVYKCLFNHKFEESMSEKCREALTTRQKLIAQDYKVSYSLAKSCKSDLKKYRCNVENLPRSREARLSYLLMCLESAVHRGRQVSSECQGEMLDYRRMLMEDFSLSPEIILSCRGEIEHHCSGLHRKGRTLHCLMKVVRGEKGNLGMNCQQALQTLIQETDPGADYRIDRALNEACESVIQTACKHIRSGDPMILSCLMEHLYTEKMVEDCEHRLLELQYFISRDWKLDPVLYRKCQGDASRLCHTHGWNETSEFMPQGAVFSCLYRHAYRTEEQGRRLSRECRAEVQRILHQRAMDVKLDPALQDKCLIDLGKWCSEKTETGQELECLQDHLDDLVVECRDIVGNLTELESEDIQIEALLMRACEPIIQNFCHDVADNQIDSGDLMECLIQNKHQKDMNEKCAIGVTHFQLVQMKDFRFSYKFKMACKEDVLKLCPNIKKKVDVVICLSTTVRNDTLQEAKEHRVSLKCRRQLRVEELEMTEDIRLEPDLYEACKSDIKNFCSAVQYGNAQIIECLKENKKQLSTRCHQKVFKLQETEMMDPELDYTLMRVCKQMIKRFCPEADSKTMLQCLKQNKNSELMDPKCKQMITKRQITQNTDYRLNPMLRKACKADIPKFCHGILTKAKDDSELEGQVISCLKLRYADQRLSSDCEDQIRIIIQESALDYRLDPQLQLHCSDEISSLCAEEAAAQEQTGQVEECLKVNLLKIKTELCKKEVLNMLKESKADIFVDPVLHTACALDIKHHCAAITPGRGRQMSCLMEALEDKRVRLQPECKKRLNDRIEMWSYAAKVAPADGFSDLAMQVMTSPSKNYILSVISGSICILFLIGLMCGRITKRVTRELKDR

SEQ ID NO: 39 - protein, 1179 aa, Homo sapiens
MAACGRVRRMFRLSAALHLLLLFAAGAEKLPGHGVHSQGQGPGANFVSFVGQAGGGGPAGQQLPQLLQSSQLQQQQQQQQQQQQLQPPQPPFPAGGPPARRGGAGAGGGWKLAEEESCREDVTRVCPKHTWSNNLAVLECLQDVREPENEISSDCNHLLWNYKLNLTTDPKFESVAREVCKSTITEIKECADEPVGKGYMVSCLVDHRGNITEYQCHQYITKMTAIIFSDYRLICGFMDDCKNDINILKCGSIRLGEKDAHSQGEVVSCLEKGLVKEAEEREPKIQVSELCKKAILRVAELSSDDFHLDRHLYFACRDDRERFCENTQAGEGRVYKCLFNHKFEESMSEKCREALTTRQKLIAQDYKVSYSLAKSCKSDLKKYRCNVENLPRSREARLSYLLMCLESAVHRGRQVSSECQGEMLDYRRMLMEDFSLSPEIILSCRGEIEHHCSGLHRKGRTLHCLMKVVRGEKGNLGMNCQQALQTLIQETDPGADYRIDRALNEACESVIQTACKHIRSGDPMILSCLMEHLYTEKMVEDCEHRLLELQYFISRDWKLDPVLYRKCQGDASRLCHTHGWNETSEFMPQGAVFSCLYRHAYRTEEQGRRLSRECRAEVQRILHQRAMDVKLDPALQDKCLIDLGKWCSEKTETGQELECLQDHLDDLVVECRDIVGNLTELESEDIQIEALLMRACEPIIQNFCHDVADNQIDSGDLMECLIQNKHQKDMNEKCAIGVTHFQLVQMKDFRFSYKFKMACKEDVLKLCPNIKKKVDVVICLSTTVRNDTLQEAKEHRVSLKCRRQLRVEELEMTEDIRLEPDLYEACKSDIKNFCSAVQYGNAQIIECLKENKKQLSTRCHQKVFKLQETEMMDPELDYTLMRVCKQMIKRFCPEADSKTMLQCLKQNKNSELMDPKCKQMITKRQITQNTDYRLNPMLRKACKADIPKFCHGILTKAKDDSELEGQVISCLKLRYADQRLSSDCEDQIRIIIQESALDYRLDPQLQLHCSDEISSLCAEEAAAQEQTGQVEECLKVNLLKIKTELCKKEVLNMLKESKADIFVDPVLHTACALDIKHHCAAITPGRGRQMSCLMEALEDKRVRLQPECKKRLNDRIEMWSYAAKVAPADGFSDLAMQVMTSPSKNYILSVISGSICILFLIGLMCGRITKRVTRELKDR

SEQ ID NO: 40 - protein, 1177 aa, Homo sapiens
MAACGRVRRMFRLSAALHLLLLFAAGGRNSPARASHSQGQGPGANFVSFVGQAGGGGPAGQQLPQLPQSSQLQQQQQQQQQQQQPQPPQPPFPAGGPPRRGGAGAGGGWKLAEEESCREDVTRVCPKHTWSNNLAVLECLQDVREPENEISSDCNHLLWNYKLNLTTDPKFESVAREVCKSTITEIKECADEPVGKGYMVSCLVDHRGNITEYQCHQYITKMTAIIFSDYRLICGFMDDCKNDINILKCGSIRLGEKDAHSQGEVVSCLEKGLVKEAEEREPKIQVSELCKKAILRVAELSSDDFHLDRHLYFACRDDRERFCENTQAGEGRVYKCLFNHKFEESMSEKCREALTTRQKLIAQDYKVSYSLAKSCKSDLKKYRCNVENLPRSREARLSYLLMCLESAVHRGRQVSSECQGEMLDYRRMLMEDFSLSPEIILSCRGEIEHHCSGLHRKGRTLHCLMKVVRGEKGNLGMNCQQALQTLIQETDPGADYRIDRALNEACESVIQTACKHIRSGDPMISSCLMEHLYTEKMVEDCEHRLLELQYFISRDWKLDPVLYRKCQGDASRLCHTHGWNETSEFMPQGAVFSCLYRHAYRTEEQGRRLSRECRAEVQRILHQRAMDVKLDPALQDKCLIDLGKWCSEKTETGQELECLQDHLDDLVVECRDIVGNLTELESEDIQIEALLMRACEPIIQTFCHDADNQIDSGDLMECLIQNKHQKDMNEKCAIGVTHFQLVQMKDFRFSYKFKMACKEDVLKLCPNIKKKVDVVICLSTTVRNDTLQEAKEHRVSLKCRRQLRVEELEMTEDIRLEPDLYEACKSDIKNFCSAVQYGNAQIIECLKENKKQLSTRCHQKVFKLQETEMMDPELDYTLMRVCKQMIKRFCPEADSKTMLQCLKQNKNSELMDPKCKQMITKRQITQNTDYRLNPMLRKACKADIPKFCHGILTKAKDDSELEGQVISCLKLRYADQRLSSDCEDQIRIIIQESALDYRLDPQLQLHCSDEISSLCAEEAAAQEQTGQVEECLKVNLLKIKTELCKKEVLNMLKESKADIFVDPVLHTACALDIKHHCAALTPGRGRQMSCLMEALEDKRVRLQPECKKRLNDRIEMWSYAAKVAPADGFSDLAMQVMTSPSKNYILSVISGSICILFLIGLMCGRITKRVTRELKDR

SEQ ID NO: 41 - protein, 1179 aa, Homo sapiens; identical to SEQ ID NO: 38

SEQ ID NO: 42 - protein, 411 aa, Homo sapiens
MWSGWWLWPLVAVCTADFFRDEAERIMRDSPVIDGHNDLPWQLLDMFNNRLQDERANLTTLAGTHTNIPKLRAGFVGGQFWSVYTPCDTQNKDAVRRTLEQMDVVHRMCRMYPETFLYVTSSAGIRQAFREGKVASLIGVEGGHSIDSSLGVLRALYQLGMRYLTLTHSCNTPWADNWLVDTGDSEPQSQGLSPFGQRVVKELNRLGVLIDLAHVSVATMKATLQLSRAPVIFSHSSAYSVCASRRNVPDDVLRLVKQTDSLVMVNFYNNYISCTNKANLSQVADHLDHIKEVAGARAVGFGGDFDGVPRVPEGLEDVSKYPDLIAELLRRNWTEAEVKGALADNLLRVFEAVEQASNLTQAPEEEPIPLDQLGGSCRTHYGYSSGASSLHRHWGLLLASLAPLVLCLSLL

SEQ ID NO: 43 - protein, 411 aa, Homo sapiens [sequence omitted]

SEQ ID NO: 44 - protein, 411 aa, Homo sapiens; identical to SEQ ID NO: 42

SEQ ID NO: 45 - protein, 152 aa, Homo sapiens
MAGLPRRIIKETQRLLAEPVPGIKAEPDESNARYFHVVIAGPQDSPFEGGTFKLELFLPEEYPMAAPKVRFMTKIYHPNVDKLGRICLDILKDKWSPALQIRTVLLSIQALLSAPNPDDPLANDVAEQWKTNEAQAIETARAWTRLYAMNNI

SEQ ID NO: 46 - protein, 152 aa, Homo sapiens; identical to SEQ ID NO: 45

SEQ ID NO: 47 - protein, 152 aa, Homo sapiens; identical to SEQ ID NO: 45

SEQ ID NO: 48 - protein, 152 aa, Homo sapiens; identical to SEQ ID NO: 45

SEQ ID NO: 49 - protein, 420 aa, Homo sapiens
MSSQVVGIEPLYIKAEPASPDSPKGSSETETEPPVALAPGPAPTRCLPGHKEEEDGEGAGPGEQGGGKLVLSSLPKRLCLVCGDVASGYHYGVASCEACKAFFKRTIQGSIEYSCPASNECEITKRRRKACQACRFTKCLRVGMLKEVQTRRGSRKLCSAGGRSRLRSGGGPGPPSAGCRRCAASGAPPAAVAPARRRSGSGRGAGMGLAGVCALRRSAGYILVGGAGGQSAAAAARRCSEGEWASGGVRSFSRAAAAMAPIKVGDAIPAVEVFEGEPGNKVNLAELFKGKKGVLFGVPGAFTPGCSKTHLPGFVEQAEALKAKGVQVVACLSVNDAFVTGEWGRAHKAEGKVRLLADPTGAFGKETDLLLDDSLVSIFGNRRLKRFSMVVQDGIVKALNVEPDGTGLTCSLAPNIISQL

SEQ ID NO: 50 - protein, 214 aa, Homo sapiens
MGLAGVCALRRSAGYILVGGAGGQSAAAAARRCSEGEWASGGVRSFSRAAAAMAPIKVGDAIPAVEVFEGEPGNKVNLAELFKGKKGVLFGVPGAFTPGCSKTHLPGFVEQAEALKAKGVQVVACLSVNDAFVTGEWGRAHKAEGKVRLLADPTGAFGKETDLLLDDSLVSIFGNRRLKRFSMVVQDGIVKALNVEPDGTGLTCSLAPNIISQL

SEQ ID NO: 51 - protein, 214 aa, Homo sapiens; identical to SEQ ID NO: 50

SEQ ID NO: 52 - protein, 170 aa, Homo sapiens
MGLAGVCALRRSAGYILVGGAGGQSAAAAARRCSEGEWASGGVRSFSRAAAAMAPIKVGDAIPAVEVFEGEPGNKVNLAELFKGKKGVLFGVPGAFTPGCSKVRLLADPTGAFGKETDLLLDDSLVSIFGNRRLKRFSMVVQDGIVKALNVEPDGTGLTCSLAPNIISQL

SEQ ID NO: 53 - protein, 214 aa, Homo sapiens; identical to SEQ ID NO: 50

SEQ ID NO: 54 - protein, 2639 aa, Homo sapiens
MSSSHSRAGQSAAGAAPGGGVDTRDAEMPATEKDLAEDAPWKKIQQNTFTRWCNEHLKCVSKRIANLQTDLSDGLRLIALLEVLSQKKMHRKHNQRPTFRQMQLENVSVALEFLDRESIKLVSIDSKAIVDGNLKLILGLIWTLILHYSISMPMWDEEEDEEAKKQTPKQRLLGWIQNKLPQLPITNFSRDWQSGRALGALVDSCAPGLCPDWDSWDASKPVTNAREAMQQADDWLGIPQVITPEEIVDPNVDEHSVMTYLSQFPKAKLKPGAPLRPKLNPKKARAYGPGIEPTGNMVKKRAEFTVETRSAGQGEVLVYVEDPAGHQEEAKVTANNDKNRTFSVWYVPEVTGTHKVTVLFAGQHIAKSPFEVYVDKSQGDASKVTAQGPGLEPSGNIANKTTYFEIFTAGAGTGEVEVVIQDPMGQKGTVEPQLEARGDSTYRCSYQPTMEGVHTVHVTFAGVPIPRSPYTVTVGQACNPSACRAVGRGLQPKGVRVKETADFKVYTKGAGSGELKVTVKGPKGEERVKQKDLGDGVYGFEYYPMVPGTYIVTITWGGQNIGRSPFEVKVGTECGNQKVRAWGPGLEGGVVGKSADFVVEAIGDDVGTLGFSVEGPSQAKIECDDKGDGSCDVRYWPQEAGEYAVHVLCNSEDIRLSPFMADIRDAPQDFHPDRVKARGPGLEKTGVAVNKPAEFTVDAKHGGKAPLRVQVQDNEGCPVEALVKDNGNGTYSCSYVPRKPVKHTAMVSWGGVSIPNSPFRVNVGAGSHPNKVKVYGPGVAKTGLKAHEPTYFTVDCAEAGQGDVSIGIKCAPGVVGPAEADIDFDIIRNDNDTFTVKYTPRGAGSYTIMVLFADQATPTSPIRVKVEPSHDASKVKAEGPGLSRTGVELGKPTHFTVNAKAAGKGKLDVQFSGLTKGDAVRDVDIIDHHDNTYTVKYTPVQQGPVGVNVTYGGDPIPKSPFSVAVSPSLDLSKIKVSGLGEKVDVGKDQEFTVKSKGAGGQGKVASKIVGPSGAAVPCKVEPGLGADNSVVRFLPREEGPYEVEVTYDGVPVPGSPFPLEAVAPTKPSKVKAFGPGLQGGSAGSPARFTIDTKGAGTGGLGLTVEGPCEAQLECLDNGDGTCSVSYVPTEPGDYNINILFADTHIPGSPFKAHVVPCFDASKVKCSGPGLERATAGEVGQFQVDCSSAGSAELTIEICSEAGLPAEVYIQDHGDGTHTITYIPLCPGAYTVTIKYGGQPVPNFPSKLQVEPAVDTSGVQCYGPGIEGQGVFREATTEFSVDARALTQTGGPHVKARVANPSGNLTETYVQDRGDGMYKVEYTPYEEGLHSVDVTYDGSPVPSSPFQVPVTEGCDPSRVRVHGPGIQSGTTNKPNKFTVETRGAGTGGLGLAVEGPSEAKMSCMDNKDGSCSVEYIPYEAGTYSLNVTYGGHQVPGSPFKVPVHDVTDASKVKCSGPGLSPGMVRANLPQSFQVDTSKAGVAPLQVKVQGPKGLVEPVDVVDNADGTQTVNYVPSREGPYSISVLYGDEEVPRSPFKVKVLPTHDASKVKASGPGLNTTGVPASLPVEFTIDAKDAGEGLLAVQITDPEGKPKKTHIQDNHDGTYTVAYVPDVTGRYTILIKYGGDEIPFSPYRVRAVPTGDASKCTVTGAGIGPTIQIGEETVITVDTKAAGKGKVTCTVCTPDGSEVDVDVVENEDGTFDIFYTAPQPGKYVICVRFGGEHVPNSPFQVTALAGDQPSVQPPLRSQQLAPQYTYAQGGQQTWAPERPLVGVNGLDVTSLRPFDLVIPFTIKKGEITGEVRMPSGKVAQPTITDNKDGTVTVRYAPSEAGLHEMDIRYDNMHIPGSPLQFYVDYVNCGHVTAYGPGLTHGVVNKPATFTVNTKDAGEGGLSLAIEGPSKAEISCTDNQDGTCSVSYLPVLPGDYSILVKYNEQHVPGSPFTARVTGDDSMRMSHLKVGSAADIPINISETDLSLLTATVVPPSGREEPCLLKRLRNGHVGISFVPKETGEHLVHVKKNGQHVASSPIPVVISQSEIGDASRVRVSGQGLHEGHTFEPAEFIIDTRDAGYGGLSLSIEGPSKVDINTEDLEDGTCRVTYCPTEPGNYIINIKFADQHVPGSPFSVKVTGEGRVKESITRRRRAPSVANVGSHCDLSLKIPEISIQDMTAQVTSPSGKTHEAEIVEGENHTYCIRFVPAEMGTHTVSVKYKGQHVPGSPFQFTVGPLGEGGAHKVRAGGPGLERAEAGVPAEFSIWTREAGAGGLAIAVEGPSKAEISFEDRKDGSCGVAYVVQEPGDYEVSVKFNEEHIPDSPFVVPVASPSGDARRLTVSSLQESGLKVNQPASFAVSLNGAKGAIDAKVHSPSGALEECYVTEIDQDKYAVRFIPRENGVYLIDVKFNGTHIPGSPFKIRVGEPGHGGDPGLVSAYGAGLEGGVTGNPAEFVVNTSNAGAGALSVTIDGPSKVKMDCQECPEGYRVTYTPMAPGSYLISIKYGGPYHIGGSPFKAKVTGPRLVSNHSLHETSSVFVDSLTKATCAPQHGAPGPGPADASKVVAKGLGLSKAYVGQKSSFTVDCSKAGNNMLLVGVHGPRTPCEEILVKHVGSRLYSVSYLLKDKGEYTLVVKWGDEHIPGSPYRVVVP

SEQ ID NO: 55 - protein, 2647 aa, Homo sapiens
MSSSHSRAGQSAAGAAPGGGVDTRDAEMPATEKDLAEDAPWKKIQQNTFTRWCNEHLKCVSKRIANLQTDLSDGLRLIALLEVLSQKKMHRKHNQRPTFRQMQLENVSVALEFLDRESIKLVSIDSKAIVDGNLKLILGLIWTLILHYSISMPMWDEEEDEEAKKQTPKQRLLGWIQNKLPQLPITNFSRDWQSGRALGALVDSCAPGLCPDWDSWDASKPVTNAREAMQQADDWLGIPQVITPEEIVDPNVDEHSVMTYLSQFPKAKLKPGAPLRPKLNPKKARAYGPGIEPTGNMVKKRAEFTVETRSAGQGEVLVYVEDPAGHQEEAKVTANNDKNRTFSVWYVPEVTGTHKVTVLFAGQHIAKSPFEVYVDKSQGDASKVTAQGPGLEPSGNIANKTTYFEIFTAGAGTGEVEVVIQDPMGQKGTVEPQLEARGDSTYRCSYQPTMEGVHTVHVTFAGVPIPRSPYTVTVGQACNPSACRAVGRGLQPKGVRVKETADFKVYTKGAGSGELKVTVKGPKGEERVKQKDLGDGVYGFEYYPMVPGTYIVTITWGGQNIGRSPFEVKVGTECGNQKVRAWGPGLEGGVVGKSADFVVEAIGDDVGTLGFSVEGPSQAKIECDDKGDGSCDVRYWPQEAGEYAVHVLCNSEDIRLSPFMADIRDAPQDFHPDRVKARGPGLEKTGVAVNKPAEFTVDAKHGGKAPLRVQVQDNEGCPVEALVKDNGNGTYSCSYVPRKPVKHTAMVSWGGVSIPNSPFRVNVGAGSHPNKVKVYGPGVAKTGLKAHEPTYFTVDCAEAGQGDVSIGIKCAPGVVGPAEADIDFDIIRNDNDTFTVKYTPRGAGSYTIMVLFADQATPTSPIRVKVEPSHDASKVKAEGPGLSRTGVELGKPTHFTVNAKAAGKGKLDVQFSGLTKGDAVRDVDIIDHHDNTYTVKYTPVQQGPVGVNVTYGGDPIPKSPFSVAVSPSLDLSKIKVSGLGEKVDVGKDQEFTVKSKGAGGQGKVASKIVGPSGAAVPCKVEPGLGADNSVVRFLPREEGPYEVEVTYDGVPVPGSPFPLEAVAPTKPSKVKAFGPGLQGGSAGSPARFTIDTKGAGTGGLGLTVEGPCEAQLECLDNGDGTCSVSYVPTEPGDYNINILFADTHIPGSPFKAHVVPCFDASKVKCSGPGLERATAGEVGQFQVDCSSAGSAELTIEICSEAGLPAEVYIQDHGDGTHTITYIPLCPGAYTVTIKYGGQPVPNFPSKLQVEPAVDTSGVQCYGPGIEGQGVFREATTEFSVDARALTQTGGPHVKARVANPSGNLTETYVQDRGDGMYKVEYTPYEEGLHSVDVTYDGSPVPSSPFQVPVTEGCDPSRVRVHGPGIQSGTTNKPNKFTVETRGAGTGGLGLAVEGPSEAKMSCMDNKDGSCSVEYIPYEAGTYSLNVTYGGHQVPGSPFKVPVHDVTDASKVKCSGPGLSPGMVRANLPQSFQVDTSKAGVAPLQVKVQGPKGLVEPVDVVDNADGTQTVNYVPSREGPYSISVLYGDEEVPRSPFKVKVLPTHDASKVKASGPGLNTTGVPASLPVEFTIDAKDAGEGLLAVQITDPEGKPKKTHIQDNHDGTYTVAYVPDVTGRYTILIKYGGDEIPFSPYRVRAVPTGDASKCTVTVSIGGHGLGAGIGPTIQIGEETVITVDTKAAGKGKVTCTVCTPDGSEVDVDVVENEDGTFDIFYTAPQPGKYVICVRFGGEHVPNSPFQVTALAGDQPSVQPPLRSQQLAPQYTYAQGGQQTWAPERPLVGVNGLDVTSLRPFDLVIPFTIKKGEITGEVRMPSGKVAQPTITDNKDGTVTVRYAPSEAGLHEMDIRYDNMHIPGSPLQFYVDYVNCGHVTAYGPGLTHGVVNKPATFTVNTKDAGEGGLSLAIEGPSKAEISCTDNQDGTCSVSYLPVLPGDYSILVKYNEQHVPGSPFTARVTGDDSMRMSHLKVGSAADIPINISETDLSLLTATVVPPSGREEPCLLKRLRNGHVGISFVPKETGEHLVHVKKNGQHVASSPIPVVISQSEIGDASRVRVSGQGLHEGHTFEPAEFIIDTRDAGYGGLSLSIEGPSKVDINTEDLEDGTCRVTYCPTEPGNYIINIKFADQHVPGSPFSVKVTGEGRVKESITRRRRAPSVANVGSHCDLSLKIPEISIQDMTAQVTSPSGKTHEAEIVEGENHTYCIRFVPAEMGTHTVSVKYKGQHVPGSPFQFTVGPLGEGGAHKVRAGGPGLERAEAGVPAEFSIWTREAGAGGLAIAVEGPSKAEISFEDRKDGSCGVAYVVQEPGDYEVSVKFNEEHIPDSPFVVPVASPSGDARRLTVSSLQESGLKVNQPASFAVSLNGAKGAIDAKVHSPSGALEECYVTEIDQDKYAVRFIPRENGVYLIDVKFNGTHIPGSPFKIRVGEPGHGGDPGLVSAYGAGLEGGVTGNPAEFVVNTSNAGAGALSVTIDGPSKVKMDCQECPEGYRVTYTPMAPGSYLISIKYGGPYHIGGSPFKAKVTGPRLVSNHSLHETSSVFVDSLTKATCAPQHGAPGPGPADASKVVAKGLGLSKAYVGQKSSFTVDCSKAGNNMLLVGVHGPRTPCEEILVKHVGSRLYSVSYLLKDKGEYTLVVKWGDEHIPGSPYRVVVP

SEQ ID NO: 56 - protein, 2647 aa, Homo sapiens
MSSSHSRAGQSAAGAAPGGGVDTRDAEMPATEKDLAEDAPWKKIQQNTFTRWCNEHLKCVSKRIANLQTDLSDGLRLIALLEVLSQKKMHRKHNQRPTFRQMQLENVSVALEFLDRESIKLVSIDSKAIVDGNLKLILGLIWTLILHYSISMPMWDEEEDEEAKKQTPKQRLLGWIQNKLPQLPITNFSRDWQSGRALGALVDSCAPGLCPDWDSWDASKPVTNAREAMQQADDWLGIPQVITPEEIVDPNVDEHSVMTYLSQFPKAKLKPGAPLRPKLNPKKARAYGPGIEPTGNMVKKRAEFTVETRSAGQGEVLVYVEDPAGHQEEAKVTANNDKNRTFSVWYVPEVTGTHKVTVLFAGQHIAKSPFEVYVDKSQGDASKVTAQGPGLEPSGNIANKTTYFEIFTAGAGTGEVEVVIQDPMGQKGTVEPQLEARGDSTYRCSYQPTMEGVHTVHVTFAGVPIPRSPYTVTVGQACNPSACRAVGRGLQPKGVRVKETADFKVYTKGAGSGELKVTVKGPKGEERVKQKDLGDGVYGFEYYPMVPGTYIVTITWGGQNIGRSPFEVKVGTECGNQKVRAWGPGLEGGVVGKSADFVVEAIGDDVGTLGFSVEGPSQAKIECDDKGDGSCDVRYWPQEAGEYAVHVLCNSEDIRLSPFMADIRDAPQDFHPDRVKARGPGLEKTGVAVNKPAEFTVDAKHGGKAPLRVQVQDNEGCPVEALVKDNGNGTYSCSYVPRKPVKHTAMVSWGGVSIPNSPFRVNVGAGSHPNKVKVYGPGVAKTGLKAHEPTYFTVDCAEAGQGDVSIGIKCAPGVVGPAEADIDFDIIRNDNDTFTVKYTPRGAGSYTIMVLFADQATPTSPIRVKVEPSHDASKVKAEGPGLSRTGVELGKPTHFTVNAKAAGKGKLDVQFSGLTKGDAVRDVDIIDHHDNTYTVKYTPVQQGPVGVNVTYGGDPIPKSPFSVAVSPSLDLSKIKVSGLGEKVDVGKDQEFTVKSKGAGGQGKVASKIVGPSGAAVPCKVEPGLGADNSVVRFLPREEGPYEVEVTYDGVPVPGSPFPLEAVAPTKPSKVKAFGPGLQGGSAGSPARFTIDTKGAGTGGLGLTVEGPCEAQLECLDNGDGTCSVSYVPTEPGDYNINILFADTHIPGSPFKAHVVPCFDASKVKCSGPGLERATAGEVGQFQVDCSSAGSAELTIEICSEAGLPAEVYIQDHGDGTHTITYIPLCPGAYTVTIKYGGQPVPNFPSKLQVEPAVDTSGVQCYGPGIEGQGVFREATTEFSVDARALTQTGGPHVKARVANPSGNLTETYVQDRGDGMYKVEYTPYEEGLHSVDVTYDGSPVPSSPFQVPVTEGCDPSRVRVHGPGIQSGTTNKPNKFTVETRGAGTGGLGLAVEGPSEAKMSCMDNKDGSCSVEYIPYEAGTYSLNVTYGGHQVPGSPFKVPVHDVTDASKVKCSGPGLSPGMVRANLPQSFQVDTSKAGVAPLQVKVQGPKGLVEPVDVVDNADGTQTVNYVPSREGPYSISVLYGDEEVPRSPFKVKVLPTHDASKVKASGPGLNTTGVPASLPVEFTIDAKDAGEGLLAVQITDPEGKPKKTHIQDNHDGTYTVAYVPDVTGRYTILIKYGGDEIPFSPYRVRAVPTGDASKCTVTVSIGGHGLGAGIGPTIQIGEETVITVDTKAAGKGKVTCTVCTPDGSEVDVDVVENEDGTFDIFYTAPQPGKYVICVRFGGEHVPNSPFQVTALAGDQPSVQPPLRSQQLAPQYTYAQGGQQTWAPERPLVGVNGLDVTSLRPFDLVIPFTIKKGEITGEVRMPSGKVAQPTITDNKDGTVTVRYAPSEAGLHEMDIRYDNMHIPGSPLQFYVDYVNCGHVTAYGPGLTHGVVNKPATFTVNTKDAGEGGLSLAIEGPSKAEISCTDNQDGTCSVSYLPVLPGDYSILVKYNEQHVPGSPFTARVTGDDSMRMSHLKVGSAADIPINISETDLSLLTATVVPPSGREEPCLLKRLRNGHVGISFVPKETGEHLVHVKKNGQHVASSPIPVVISQSEIGDASRVRVSGQGLHEGHTFEPAEFIIDTRDAGYGGLSLSIEGPSKVDINTEDLEDGTCRVTYCPTEPGNYIINIKFADQHVPGSPFSVKVTGEGRVKESITRRRRAPSVANVGSHCDLSLKIPEISIQDMTAQVTSPSGKTHEAEIVEGENHTYCIRFVPAEMGTHTVSVKYKGQHVPGSPFQFTVGPLGEGGAHKVRAGGPGLERAEAGVPAEFSIWTREAGAGGLAIAVEGPSKAEISFEDRKDGSCGVAYVVQEPGDYEVSVKFNEEHIPDSPFVVPVASPSGDARRLTVSSLQESGLKVNQPASFAVSLNGAKGAIDAKVHSPSGALEECYVTEIDQDKYAVRFIPRENGVYLIDVKFNGTHIPGSPFKIRVGEPGHGGDPGLVSAYGAGLEGGVTGNPAEFVVNTSNAGAGALSVTIDGPSKVKMDCQECPEGYRVTYTPMAPGSYLISIKYGGPYHIGGSPFKAKVTGPRLVSNHSLHETSSVFVDSLTKATCAPQHGAPGPGPADASKVVAKGLGLSKAYVGQKSSFTVDCSKAGNNMLLVGVHGPRTPCEEILVKHVGSRLYSVSYLLKDKGEYTLVVKWGHEHIPGSPYRVVVP

SEQ ID NO: 57 - protein, 2337 aa, Homo sapiens [sequence omitted]

SEQ ID NO: 58 - protein, 1508 aa, Homo sapiens
MSSSHSRAGQSAAGAAPGGGVDTRDAEMPATEKDLAEDAPWKKIQQNTFTRWCNEHLKCVSKRIANLQTDLSDGLRLIALLEVLSQKKMHRKHNQRPTFRQMQLENVSVALEFLDRESIKLVSIDSKAIVDGNLKLILGLIWTLILHYSISMPMWDEEEDEEAKKQTPKQRLLGWIQNKLPQLPITNFSRDWQSGRALGALVDSCAPGLCPDWDSWDASKPVTNAREAMQQADDWLGIPQVITPEEIVDPNVDEHSVMTYLSQFPKAKLKPGAPLRPKLNPKKARAYGPGIEPTGNMVKKRAEFTVETRSAGQGEVLVYVEDPAGHQEEAKVTANNDKNRTFSVWYVPEVTGTHKVTVLFAGQHIAKSPFEVYVDKSQGDASKVTAQGPGLEPSGNIANKTTYFEIFTAGAGTGEVEVVIQDPMGQKGTVEPQLEARGDSTYRCSYQPTMEGVHTVHVTFAGVPIPRSPYTVTVGQACNPSACRAVGRGLQPKGVRVKETADFKVYTKGAGSGELKVTVKGPKGEERVKQKDLGDGVYGFEYYPMVPGTYIVTITWGGQNIGRSPFEVKVGTECGNQKVRAWGPGLEGGVVGKSADFVVEAIGDDVGTLGFSVEGPSQAKIECDDKGDGSCDVRYWPQEAGEYAVHVLCNSEDIRLSPFMADIRDAPQDFHPDRVKARGPGLEKTGVAVNKPAEFTVDAKHGGKAPLRVQVQDNEGCPVEALVKDNGNGTYSCSYVPRKPVKHTAMVSWGGVSIPNSPFRVNVGAGSHPNKVKVYGPGVAKTGLKAHEPTYFTVDCAEAGQGDVSIGIKCAPGVVGPAEADIDFDIIRNDNDTFTVKYTPRGAGSYTIMVLFADQATPTSPIRVKVEPSHDASKVKAEGPGLSRTGVELGKPTHFTVNAKAAGKGKLDVQFSGLTKGDAVRDVDIIDHHDNTYTVKYTPVQQGPVGVNVTYGGDPIPKSPFSVAVSPSLDLSKIKVSGLGEKVDVGKDQEFTVKSKGAGGQGKVASKIVGPSGAAVPCKVEPGLGADNSVVRFLPREEGPYEVEVTYDGVPVPGSPFPLEAVAPTKPSKVKAFGPGLQGGSAGSPARFTIDTKGAGTGGLGLTVEGPCEAQLECLDNGDGTCSVSYVPTEPGDYNINILFADTHIPGSPFKAHVVPCFDASKVKCSGPGLERATAGEVGQFQVDCSSAGSAELTIEICSEAGLPAEVYIQDHGDGTHTITYIPLCPGAYTVTIKYGGQPVPNFPSKLQVEPAVDTSGVQCYGPGIEGQGVFREATTEFSVDARALTQTGGPHVKARVANPSGNLTETYVQDRGDGMYKVEYTPYEEGLHSVDVTYDGSPVPSSPFQVPVTEGCDPSRVRVHGPGIQSGTTNKPNKFTVETRGAGTGGLGLAVEGPSEAKMSCMDNKDGSCSVEYIPYEAGTYSLNVTYGGHQVPGSPFKVPVHDVTDASKVKCSGPGLSPGMVRANLPQSFQVDTSKAGVAPLQVKVQGPKGECLHAWSQGSGGQCPV

SEQ ID NO: 59 - protein, 2480 aa, Homo sapiens
MSSSHSRAGQSAAGAAPGGGVDTRDAEMPATEKDLAEDAPWKKIQQNTFTRWCNEHLKCVSKRIANLQTDLSDGLRLIALLEVLSQKKMHRKHNQRPTFRQMQLENVSVALEFLDRESIKLVSIDSKAIVDGNLKLILGLIWTLILHYSISMPMWDEEEDEEAKKQTPKQRLLGWIQNKLPQLPITNFSRDWQSGRALGALVDSCAPGLCPDWDSWDASKPVTNAREAMQQADDWLGIPQVITPEEIVDPNVDEHSVMTYLSQFPKAKLKPGAPLRPKLNPKKARAYGPGIEPTGNMVKKRAEFTVETRSAGQGEVLVYVEDPAGHQEEAKVTANNDKNRTFSVWYVPEVTGTHKVTVLFAGQHIAKSPFEVYVDKSQGDASKVTAQGPGLEPSGNIANKTTYFEIFTAGAGTGEVEVVIQDPMGQKGTVEPQLEARGDSTYRCSYQPTMEGVHTVHVTFAGVPIPRSPYTVTVGQACNPSACRAVGRGLQPKGVRVKETADFKVYTKGAGSGELKVTVKGPKGEERVKQKDLGDGVYGFEYYPMVPGTYIVTITWGGQNIGRSPFEVKVGTECGNQKVRAWGPGLEGGVVGKSADFVVEAIGDDVGTLGFSVEGPSQAKIECDDKGDGSCDVRYWPQEAGEYAVHVLCNSEDIRLSPFMADIRDAPQDFHPDRVKARGPGLEKTGVAVNKPAEFTVDAKHGGKAPLRVQVQDNEGCPVEALVKDNGNGTYSCSYVPRKPVKHTAMVSWGGVSIPNSPFRVNVGAGSHPNKVKVYGPGVAKTGLKAHEPTYFTVDCAEAGQGDVSIGIKCAPGVVGPAEADIDFDIIRNDNDTFTVKYTPRGAGSYTIMVLFADQATPTSPIRVKVEPSHDASKVKAEGPGLSRTGVELGKPTHFTVNAKAAGKGKLDVQFSGLTKGDAVRDVDIIDHHDNTYTVKYTPVQQGPVGVNVTYGGDPIPKSPFSVAVSPSLDLSKIKVSGLGEKVDVGKDQEFTVKSKGAGGQGKVASKIVGPSGAAVPCKVEPGLGADNSVVRFLPREEGPYEVEVTYDGVPVPGSPFPLEAVAPTKPSKVKAFGPGLQGGSAGSPARFTIDTKGAGTGGLGLTVEGPCEAQLECLDNGDGTCSVSYVPTEPGDYNINILFADTHIPGSPFKAHVVPCFDASKVKCSGPGLERATAGEVGQFQVDCSSAGSAELTIEICSEAGLPAEVYIQDHGDGTHTITYIPLCPGAYTVTIKYGGQPVPNFPSKLQVEPAVDTSGVQCYGPGIEGQGVFREATTEFSVDARALTQTGGPHVKARVANPSGNLTETYVQDRGDGMYKVEYTPYEEGLHSVDVTYDGSPVPSSPFQVPVTEGCDPSRVRVHGPGIQSGTTNKPNKFTVETRGAGTGGLGLAVEGPSEAKMSCMDNKDGSCSVEYIPYEAGTYSLNVTYGGHQVPGSPFKVPVHDVTDASKVKCSGPGLSPGMVRANLPQSFQVDTSKAGVAPLQVKVQGPKGLVEPVDVVDNADGTQTVNYVPSREGPYSISVLYGDEEVPRSPFKVKVLPTHDASKVKASGPGLNTTGVPASLPVEFTIDAKDAGEGLLAVQITDPEGKPKKTHIQDNHDGTYTVAYVPDVTGRYTILIKYGGDEIPFSPYRVRAVPTGDASKCTVTVSIGGHGLGAGIGPTIQIGEETVITVDTKAAGKGKVTCTVCTPDGSEVDVDVVENEDGTFDIFYTAPQPGKYVICVRFGGEHVPNSPFQVTALAGDQPSVQPPLRSQQLAPQYTYAQGGQQTWAPERPLVGVNGLDVTSLRPFDLVIPFTIKKGEITGEVRMPSGKVAQPTITDNKDGTVTVRYAPSEAGLHEMDIRYDNMHIPGSPLQFYVDYVNCGHVTAYGPGLTHGVVNKPATFTVNTKDAGEGGLSLAIEGPSKAEISCTDNQDGTCSVSYLPVLPGDYSILVKYNEQHVPGSPFTARVTGDDSMRMSHLKVGSAADIPINISETDLSLLTATVVPPSGREEPCLLKRLRNGHVGISFVPKETGEHLVHVKKNGQHVASSPIPVVISQSEIGDASRVRVSGQGLHEGHTFEPAEFIIDTRDAGYGGLSLSIEGPSKVDINTEDLEDGTCRVTYCPTEPGNYIINIKFADQHVPGSPFSVKVTGEGRVKESITRRRRAPSVANVGSHCDLSLKIPEISIQDMTAQVTSPSGKTHEAEIVEGENHTYCIRFVPAEMGTHTVSVKYKGQHVPGSPFQFTVGPLGEGGAHKVRAGGPGLERAEAGVPAEFSIWTREAGAGGLAIAVEGPSKAEISFEDRKDGSCGVAYVVQEPGDYEVSVKFNEEHIPDSPFVVPVASPSGDARRLTVSSLQVRHREKPPTWGSWARTDQSHRRDQALALCSVTPLAQLWVPGLCSGRVQPTLGVGRKYPAHHVEFFSCLRSKGFEQKPVPLEHQGCGLKRDSLPRLGAAHRVGQPSLPATWVCATAECGGRGGDVRLWLAAPCKSVALPL

SEQ ID NO: 60 - protein, 362 aa, Homo sapiens
MRVTAPRTVLLLLSGALALTETWAGSHSMRYFYTAMSRPGRGEPRFIAVGYVDDTQFVRFDSDAASPRMAPRAPWIEQEGPEYWDRETQKYKRQAQTDRVSLRNLRGYYNQSEAGSHTLQRMYGCDVGPDGRLLRGHDQSAYDGKDYIALNEDLSSWTAADTAAQITQRKWEAAREAEQWRAYLEGLCVEWLRRYLENGKETLQRADPPKTHVTHHPISDHEATLRCWALGFYPAEITLTWQRDGEDQTQDTELVETRPAGDRTFQKWAAVVVPSGEEQRYTCHVQHEGLPKPLTLRWEPSSQSTIPIVGIVAGLAVLAVVVIGAVVATVMCRRKSSGGKGGSYSQAASSDSAQGSDVSLTA

SEQ ID NO: 61 - protein, 366 aa, Homo sapiens [sequence omitted]

SEQ ID NO: 62 - protein, 362 aa, Homo sapiens [sequence omitted]

SEQ ID NO: 63 - protein, 362 aa, Homo sapiens [sequence omitted]

SEQ ID NO: 64 - protein, 362 aa, Homo sapiens [sequence omitted]

SEQ ID NO: 65 - protein, 362 aa, Homo sapiens [sequence omitted]

SEQ ID NO: 66 - protein, 362 aa, Homo sapiens [sequence omitted]

SEQ ID NO: 67 - protein, 342 aa, Homo sapiens
CSHSMRYFDTAVSRPGAGEPRFISVGYVDDTQFVRFDSDAASPRGEPRAPWVEQEGPEYWDRETQKYKRQAQADRVSLRNLRGYYNQSEDGSHTLQRMSGCDLGPDGRLLRGYDQSAYDGKDYIALNEDLRSWTAADTAAQITQRKWEAARAAEQLRAYLEGLCVEWLRRYLENGKETLQRAEPPKTHVTHHPLSDHEATLRCWALGFYPAEITLTWQRDGEDQTQDTELVETRPAGDGTFQKWAAVVVPSGQEQRYTCHMQHEGLQEPLTLSWEPSSQPTIPIMGIVAGLAVLVVLAVLGAVVTAMMCRRKSSGGKGGSCSQAACSNSAQGSDESLITCKA

SEQ ID NO: 68 - protein, 362 aa, Homo sapiens [sequence omitted]

SEQ ID NO: 69 - protein, 362 aa, Homo sapiens [sequence omitted]

SEQ ID NO: 70 - protein, 362 aa, Homo sapiens [sequence omitted]

SEQ ID NO: 71 - protein, 362 aa, Homo sapiens [sequence omitted]

SEQ ID NO: 72 - protein, 362 aa, Homo sapiens [sequence omitted]

SEQ ID NO: 73 - protein, 366 aa, Homo sapiens [sequence omitted]

SEQ ID NO: 74 - protein, 362 aa, Homo sapiens [sequence omitted]

SEQ ID NO: 75 - protein, 362 aa, Homo sapiens [sequence omitted]

SEQ ID NO: 76 - protein, 362 aa, Homo sapiens [sequence omitted]

SEQ ID NO: 77 - protein, 362 aa, Homo sapiens [sequence omitted]

SEQ ID NO: 78 - protein, 366 aa, Homo sapiens
MRVMAPRTLILLLSGALALTETWAGSHSMRYFYTAVSRPGRGEPHFIAVGYVDDTQFVRFDSDAASPRGEPRAPWVEQEGPEYWDRETQKYKRQAQTDRVSLRNLRGYYNQSEAGSHIIQRMYGCDVGPDGRLLRGYDQYAYDGKDYIALNEDLRSWTAADTAAQITQRKWEAAREAEQLRAYLEGLCVEWLRRYLKNGKETLQRAEHPKTHVTHHPVSDHEATLRCWALGFYPAEITLTWQWDGEDQTQDTELVETRPAGDGTFQKWAAVVVPSGEEQRYTCHVQHEGLPEPLTLRWEPSSQPTIPIVGIVAGLAVLAVLAVLGAVVAVVMCRRKSSGGKGGSCSQAASSNSAQGSDESLIACKA

SEQ ID NO: 79 - protein, 362 aa, Homo sapiens [sequence omitted]

SEQ ID NO: 80 - protein, 362 aa, Homo sapiens
MRVTAPRTVLLLLSGALALTETWAGSHSMRYFYTAMSRPGRGEPRFIAVGYVDDTQFVRFDSDAASPRMAPRAPWIEQEGPEYWDRETQISKTNTQTYRESLRNLRGYYNQSEAGSHTLQRMYGCDVGPDGRLLRGHDQSAYDGKDYIALNEDLSSWTAADTAAQITQRKWEAAREAEQWRAYLEGLCVEWLRRYLENGKETLQRADPPKTHVTHHPISDHEATLRCWALGFYPAEITLTWQRDGEDQTQDTELVETRPAGDRTFQKWAAVVVPSGEEQRYTCHVQHEGLPKPLTLRWEPSSQSTIPIVGIVAGLAVLAVVVIGAVVATVMCRRKSSGGKGGSYSQAASSDSAQGSDVSLTA

SEQ ID NO: 81 - protein, 362 aa, Homo sapiens [sequence omitted]

SEQ ID NO: 82 - protein, 362 aa, Homo sapiens [sequence omitted]

SEQ ID NO: 83 - protein, 362 aa, Homo sapiens [sequence omitted]

SEQ ID NO: 84 - protein, 362 aa, Homo sapiens [sequence omitted]

SEQ ID NO: 85 - protein, 362 aa, Homo sapiens [sequence omitted]

SEQ ID NO: 86 - protein, 362 aa, Homo sapiens [sequence omitted]

SEQ ID NO: 87 - protein, 362 aa, Homo sapiens [sequence omitted]

SEQ ID NO: 88 - protein, 362 aa, Homo sapiens [sequence omitted]

SEQ ID NO: 89 - protein, 362 aa, Homo sapiens [sequence omitted]

SEQ ID NO: 90 - protein, 376 aa, Homo sapiens
MLPLSIKDDEYKPPKFNLFGKISGWFRSILSDKTSRNLFFFLCLNLSFAFVELLYGIWSNCLGLISDSFHMFFDSTAILAGLAASVISKWRDNDAFSYGYVRAEVLAGFVNGLFLIFTAFFIFSEGVERALAPPDVHHERLLLVSILGFVVNLIGIFVFKHGGHGHSHGSGHGHSHSLFNGALDQAHGHVDHCHSHEVKHGAAHSHDHAHGHGHFHSHDGPSLKETTGPSRQILQGVFLHILADTLGSIGVIASAIMMQNFGLMIADPICSILIAILIVVSVIPLLRESVGILMQRTPPLLENSLPQCYQRVQQLQGVYSLQEQHFWTLCSDVYVGTLKLIVAPDADARWILSQTHNIFTQAGVRQLYVQIDFAAM

SEQ ID NO: 91 - protein, 376 aa, Homo sapiens; identical to SEQ ID NO: 90

SEQ ID NO: 92 - protein, 879 aa, Homo sapiens [sequence omitted]

SEQ ID NO: 93 - protein, 861 aa, Homo sapiens
MEALGPGPPASLFQPPRRPGLGTVGKPIRLLANHFQVQIPKIDVYHYDVDIKPEKRPRRVNREVVDTMVRHFKMQIFGDRQPGYDGKRNMYTAHPLPIGRDRVDMEVTLPGEGKDQTFKVSVQWVSVVSLQLLLEALAGHLNEVPDDSVQALDVITRHLPSMRYTPVGRSFFSPPEGYYHPLGGGREVWFGFHQSVRPAMWNMMLNIDVSATAFYRAQPIIEFMCEVLDIQNINEQTKPLTDSQRVKFTKEIRGLKVEVTHCGQMKRKYRVCNVTRRPASHQTFPLQLENGQAMECTVAQYFKQKYSLQLKYPHLPCLQVGQEQKHTYLPLEVCNIVAGQRCIKKLTDNQTSTMIKATARSAPDRQEEISRLVKSNSMVGGPDPYLKEFGIVVHNEMTELTGRVLPAPMLQYGGRNKTVATPNQGVWDMRGKQFYAGIEIKVWAVACFAPQKQCREDLLKSFTDQLRKISKDAGMPIQGQPCFCKYAQGADSVEPMFKHLKMTYVGLQLIVVILPGKTPVYAEVKRVGDTLLGMATQCVQVKNVVKTSPQTLSNLCLKINAKLGGINNVLVPHQRPSVFQQPVIFLGADVTHPPAGDGKKPSIAAVVGSMDGHPSRYCATVRVQTSRQEISQELLYSQEVIQDLTNMVRELLIQFYKSTRFKPTRIIYYRGGVSEGQMKQVAWPELIAIRKACISLEEDYRPGITYIVVQKRHHTRLFCADKTERVGKSGNVPAGTTVDSTITHPSEFDFYLCSHAGIQGTSRPSHYQVLWDDNCFTADELQLLTYQLCHTYVRCTRSVSIPAPAYYARLVAFRARYHLVDKDHDSAEGSHVSGQSNGRDPQALAKAVQIHHDTQHTMYFA

SEQ ID NO: 94 - protein, 860 aa, Homo sapiens [sequence omitted]

SEQ ID NO: 95 - protein, 846 aa, Homo sapiens [sequence omitted]

SEQ ID NO: 96 - protein, 857 aa, Homo sapiens
MEAGPSGAAAGAYLPPLQQVFQAPRRPGIGTVGKPIKLLANYFEVDIPKIDVYHYEVDIKPDKCPRRVNREVVEYMVQHFKPQIFGDRKPVYDGKKNIYTVTALPIGNERVDFEVTIPGEGKDRIFKVSIKWLAIVSWRMLHEALVSGQIPVPLESVQALDVAMRHLASMRYTPVGRSFFSPPEGYYHPLGGGREVWFGFHQSVRPAMWKMMLNIDVSATAFYKAQPVIEFMCEVLDIRNIDEQPKPLTDSQRVRFTKEIKGLKVEVTHCGQMKRKYRVCNVTRRPASHQTFPLQLESGQTVECTVAQYFKQKYNLQLKYPHLPCLQVGQEQKHTYLPLEVCNIVAGQRCIKKLTDNQTSTMIKATARSAPDRQEEISRLMKNASYNLDPYIQEFGIKVKDDMTEVTGRVLPAPILQYGGRNRAIATPNQGVWDMRGKQFYNGIEIKVWAIACFAPQKQCREEVLKNFTDQLRKISKDAGMPIQGQPCFCKYAQGADSVEPMFRHLKNTYSGLQLIIVILPGKTPVYAEVKRVGDTLLGMATQCVQVKNVVKTSPQTLSNLCLKINVKLGGINNILVPHQRSAVFQQPVIFLGADVTHPPAGDGKKPSITAVVGSMDAHPSRYCATVRVQRPRQEIIEDLSYMVRELLIQFYKSTRFKPTRIIFYRDGVPEGQLPQILHYELLAIRDACIKLEKDYQPGITYIVVQKRHHTRLFCADKNERIGKSGNIPAGTTVDTNITHPFEFDFYLCSHAGIQGTSRPSHYYVLWDDNRFTADELQILTYQLCHTYVRCTRSVSIPAPAYYARLVAFRARYHLVDKEHDSGEGSHISGQSNGRDPQALAKAVQVHQDTLRTMYFA

SEQ ID NO: 97 - protein, 860 aa, Homo sapiens
MEIGSAGPAGAQPLLMVPRRPGYGTMGKPIKLLANCFQVEIPKIDVYLYEVDIKPDKCPRRVNREVVDSMVQHFKVTIFGDRRPVYDGKRSLYTANPLPVATTGVDLDVTLPGEGGKDRPFKVSIKFVSRVSWHLLHEVLTGRTLPEPLELDKPISTNPVHAVDVVLRHLPSMKYTPVGRSFFSAPEGYDHPLGGGREVWFGFHQSVRPAMWKMMLNIDVSATAFYKAQPVIQFMCEVLDIHNIDEQPRPLTDSHRVKFTKEIKGLKVEVTHCGTMRRKYRVCNVTRRPASHQTFPLQLENGQTVERTVAQYFREKYTLQLKYPHLPCLQVGQEQKHTYLPLEVCNIVAGQRCIKKLTDNQTSTMIKATARSAPDRQEEISRLVRSANYETDPFVQEFQFKVRDEMAHVTGRVLPAPMLQYGGRNRTVATPSHGVWDMRGKQFHTGVEIKMWAIACFATQRQCREEILKGFTDQLRKISKDAGMPIQGQPCFCKYAQGADSVEPMFRHLKNTYSGLQLIIVILPGKTPVYAEVKRVGDTLLGMATQCVQVKNVIKTSPQTLSNLCLKINVKLGGINNILVPHQRPSVFQQPVIFLGADVTHPPAGDGKKPSIAAVVGSMDAHPSRYCATVRVQRPRQEIIQDLASMVRELLIQFYKSTRFKPTRIIFYRDGVSEGQFRQVLYYELLAIREACISLEKDYQPGITYIVVQKRHHTRLFCADRTERVGRSGNIPAGTTVDTDITHPYEFDFYLCSHAGIQGTSRPSHYHVLWDDNCFTADELQLLTYQLCHTYVRCTRSVSIPAPAYYAHLVAFRARYHLVDKEHDSAEGSHVSGQSNGRDPQALAKAVQIHQDTLRTMYFA

SEQ ID NO: 98 - protein, 857 aa, Homo sapiens; identical to SEQ ID NO: 96

SEQ ID NO: 99 - protein, 860 aa, Homo sapiens; identical to SEQ ID NO: 97

SEQ ID NO: 100 - protein, 338 aa, Homo sapiens
MLSALARPASAALRRSFSTSAQNNAKVAVLGASGGIGQPLSLLLKNSPLVSRLTLYDIAHTPGVAADLSHIETKAAVKGYLGPEQLPDCLKGCDVVVIPAGVPRKPGMTRDDLFNTNATIVATLTAACAQHCPEAMICVIANPVNSTIPITAEVFKKHGVYNPNKIFGVTTLDIVRANTFVAELKGLDPARVNVPVIGGHAGKTIIPLISQCTPKVDFPQDQLTALTGRIQEAGTEVVKAKAGAGSATLSMAYAGARFVFSLVDAMNGKEGVVECSFVKSQETECTYFSTPLLLGKKGIEKNLGIGKVSSFEEKMISDAIPELKASIKKGEDFVKTLK

SEQ ID NO: 101 - protein, 338 aa, Homo sapiens [sequence omitted]

SEQ ID NO: 102 - protein, 338 aa, Homo sapiens; identical to SEQ ID NO: 100

SEQ ID NO: 103 - protein, 338 aa, Homo sapiens; identical to SEQ ID NO: 100

SEQ ID NO: 104 - protein, 512 aa, Homo sapiens
MKAIIHLTLLALLSVNTATNQGNSADAVTTTETATSGPTVAAADTTETNFPETASTTANTPSFPTATSPAPPIISTHSSSTIPTPAPPIISTHSSSTIPIPTAADSESTTNVNSLATSDIITASSPNDGLITMVPSETQSNNEMSPTTEDNQSSGPPTGTALLETSTLNSTGPSNPCQDDPCADNSLCVKLHNTSFCLCLEGYYYNSSTCKKGKVFPGKISVTVSETFDPEEKHSMAYQDLHSEITSLFKDVFGTSVYGQTVILTVSTSLSPRSEMRADDKFVNVTIVTILAETTSDNEKTVTEKINKAIRSSSSNFLNYDLTLRCDYYGCNQTADDCLNGLACDCKSDLQRPNPQSPFCVASSLKCPDACNAQHKQCLIKKSGGAPECACVPGYQEDANGNCQKCAFGYSGLDCKDKFQLILTIVGTIAGIVILSMIIALIVTARSNNKTKHIEEENLIDEDFQNLKLRSTGFTNLGAEGSVFPKVRITASRDSQMQNPYSRHSSMPRPDY

SEQ ID NO: 105 - protein, 512 aa, Homo sapiens [sequence omitted]

SEQ ID NO: 106 - protein, 357 aa, Homo sapiens
MATTVPDGCRNGLKSKYYRLCDKAEAWGIVLETVATAGVVTSVAFMLTLPILVCKVQDSNRRKMLPTQFLFLLGVLGIFGLTFAFIIGLDGSTGPTRFFLFGILFSICFSCLLAHAVSLTKLVRGRKPLSLLVILGLAVGFSLVQDVIAIEYIVLTMNRTNVNVFSELSAPRRNEDFVLLLTYVLFLMALTFLMSSFTFCGSFTGWKRHGAHIYLTMLLSIAIWVAWITLLMLPDFDRRWDDTILSSALAANGWVFLLAYVSPEFWLLTKQRNPMDYPVEDAFCKPQLVKKSYGVENRAYSQEEITQGFEETGDTLYAPYSTHFQLQNQPPQKEFSIPRAHAWPSPYKDYEVKKEGS

SEQ ID NO: 107 - protein, 357 aa, Homo sapiens; identical to SEQ ID NO: 106

SEQ ID NO: 108 - protein, 584 aa, Homo sapiens
MCYTHALFLQRQLRPRRSEAGRFRPRALRPDVSVARSAVTKSAGLYWRGPDGRGLCGAVLGDTRRCPVLAMADYLISGGTSYVPDDGLTAQQLFNCGDGLTYNDFLILPGYIDFTADQVDLTSALTKKITLKTPLVSSPMDTVTEAGMAIAMALTGGIGFIHHNCTPEFQANEVRKVKKYEQGFITDPVVLSPKDRVRDVFEAKARHGFCGIPITDTGRMGSRLVGIISSRDIDFLKEEEHDCFLEEIMTKREDLVVAPAGITLKEANEILQRSKKGKLPIVNEDDELVAIIARTDLKKNRDYPLASKDAKKQLLCGAAIGTHEDDKYRLDLLAQAGVDVVVLDSSQGNSIFQINMIKYIKDKYPNLQVIGGNVVTAAQAKNLIDAGVDALRVGMGSGSICITQEVLACGRPQATAVYKVSEYARRFGVPVIADGGIQNVGHIAKALALGASTVMMGSLLAATTEAPGEYFFSDGIRLKKYRGMGSLDAMDKHLSSQNRYFSEADKIKVAQGVSGAVQDKGSIHKFVPYLIAGIQHSCQDIGAKSLTQVRAMMYSGELKFEKRTSSAQVEGGVHSLHSYEKRLF

SEQ ID NO: 109 - protein, 584 aa, Homo sapiens; identical to SEQ ID NO: 108

SEQ ID NO: 110 - protein, 514 aa, Homo sapiens
MADYLISGGTSYVPDDGLTAQQLFNCGDGLTYNDFLILPGYIDFTADQVDLTSALTKKITLKTPLVSSPMDTVTEAGMAIAMALTGGIGFIHHNCTPEFQANEVRKVKKYEQGFITDPVVLSPKDRVRDVFEAKARHGFCGIPITDTGRMGSRLVGIISSRDIDFLKEEEHDCFLEEIMTKREDLVVAPAGITLKEANEILQRSKKGKLPIVNEDDELVAIIARTDLKKNRDYPLASKDAKKQLLCGAAIGTHEDDKYRLDLLAQAGVDVVVLDSSQGNSIFQINMIKYIKDKYPNLQVIGGNVVTAAQAKNLIDAGVDALRVGMGSGSICITQEVLACGRPQATAVYKVSEYARRFGVPVIADGGIQNVGHIAKALALGASTVMMGSLLAATTEAPGEYFFSDGIRLKKYRGMGSLDAMDKHLSSQNRYFSEADKIKVAQGVSGAVQDKGSIHKFVPYLIAGIQHSCQDIGAKSLTQVRAMMYSGELKFEKRTSSAQVEGGVHSLHSYEKRLF

SEQ ID NO: 111 - protein, 584 aa, Homo sapiens; identical to SEQ ID NO: 108

SEQ ID NO: 112 - protein, 511 aa, Homo sapiens
MCYTHALFLQRQLRPRRSEAGRFRPRALRPDVSVARSAVTKSAGLYWRGPDGRGLCGAVLGDTRRCPVLAMADYLISGGTSYVPDDGLTAQTSALTKKITLKTPLVSSPMDTVTEAGMAIAMALTGGIGFIHHNCTPEFQANEVRKVKKYEQGFITDPVVLSPKDRVRDVFEAKARHGFCGIPITDTGRMGSRLVGIISSRDIDFLKEEEHDCFLEEIMTKREDLVVAPAGITLKEANEILQRSKKGARTDLKKNRDYPLASKDAKKQLLCGAAIGTHEDDKYRLDLLAQAGVDVVVLDSSQGNSIFQINMIKYIKDKYPNLQVIGGNVVTAAQAKNLIDAGVDALRVGMGSGSICITQEVLACGRPQATAVYKVSEYARRFGVPVIADGGIQNVGHIAKALALGASTVMMGSLLAATTEAPGEYFFSDGIRLKKYRGMGSLDAMDKHLSSQNRYFSEADKIKVAQGVSGAVQDKGSIHKFVPYLIAGIQHSCQDIGAKSLTQSHDVLWGA

SEQ ID NO: 113 - protein, 464 aa, Homo sapiens
MCYTHALFLQRQLRPRRSEAGRFRPRALRPDVSVARSAVTKSAGLYWRGPDGRGLCGAVLGDTRRCPVLAMADYLISGGTSYVPDDGLTAQQLFNCGDGLTYNDFLILPGYIDFTADQVDLTSALTKKITLKTPLVSSPMDTVTEAGMAIAMALTGGIGFIHHNCTPEFQANEVRKVKKYEQGFITDPVVLSPKDRVRDVFEAKARHGFCGIPITDTGRMGSRLVGIISSRDIDFLKEEEHDCFLEEIMTKREDLVVAPAGITLKEANEILQRSKKGKLPIVNEDDELVAIIARTDLKKNRDYPLASKDAKKQLLCGAAIGTHEDDKYRLDLLAQAGVDVVVLDSSQGNSIFQINMIKYIKDKYPNLQVIGGNVVTAAQAKNLIDAGVDALRVGMGSGSICITQEVLACGRPQATAVYKVSEYARRFGVPVIADGGIQNVGHIAKALALGAVRSHDGLSPGCHH

SEQ ID NO: 114 - protein, 584 aa, Homo sapiens; identical to SEQ ID NO: 108

SEQ ID NO: 115 - protein, 417 aa, Homo sapiens
MSLSNKLTLDKLDVKGKRVVMRVDFNVPMKNNQITNNQRIKAAVPSIKFCLDNGAKSVVLMSHLGRPDGVPMPDKYSLEPVAVELKSLLGKDVLFLKDCVGPEVEKACANPAAGSVILLENLRFHVEEEGKGKDASGNKVKAEPAKIEAFRASLSKLGDVYVNDAFGTAHRAHSSMVGVNLPQKAGGFLMKKELNYFAKALESPERPFLAILGGAKVADKIQLINNMLDKVNEMIIGGGMAFTFLKVLNNMEIGTSLFDEEGAKIVKDLMSKAEKNGVKITLPVDFVTADKFDENAKTGQATVASGIPAGWMGLDCGPESSKKYAEAVTRAKQIVWNGPVGVFEWEAFARGTKALMDEVVKATSRGCITIIGGGDTATCCAKWNTEDKVSHVSTGGGASLELLEGKVLPGVDALSNI

SEQ ID NO: 116 - protein, 168 aa, Homo sapiens
MEDKIYDRQVTKQSLSFRVVDQQQVERHFTMNELTELYTFEPDLLDDPNSEKKKKRDTPMLPKGLDCGPESSKKYAEAVTRAKQIVWNGPVGVFEWEAFARGTKALMDEVVKATSRGCITIIGGGDTATCCAKWNTEDKVSHVSTGGGASLELLEGKVLPGVDALSNI

SEQ ID NO: 117 - protein, 417 aa, Homo sapiens; identical to SEQ ID NO: 115

SEQ ID NO: 118 - protein, 410 aa, Homo sapiens
MSLSNKLTLDKLDVKGKRVVMRVDFNVPMKNNQITNNQRIKAAVPSIKFCLDNGAKSVVLMSHLGRPDGVPMPDKYSLEPVAVELKSLLGKDVLFLKDCVGPEVEKACANPAAGSVILLENLRFHVEEEGKGKDASGNKVKAEPAKIEAFRASLSKLGDVYVNDAFGTAHRAHSSMVGVNLPQKAGGFLMKKELNYFAKALESPERPFLAILGGAKVADKIQLINNMLDKVNEMIIGGGMAFTFLKVLNNMEIGTSLFDEEGAKIVKDLMSKAEKNGVKITLPVDFVTADKFDENAKTGQATVASGIPAGWMGLDCGPESSKKYAEAVTRAKQIVWNGPVGVFEWEAFARGTKALMDEVVKATSRGCITIIGGGDTATCCAKWNTEDKVSHVSTGGGASLELLEVPVHSP

SEQ ID NO: 119 - protein, 356 aa, Homo sapiens
TLWRGKLSSTLLLVFNFHTAQVSSSLPLLRDVLFLKDCVGPEVEKACANPAAGSVILLENLRFHVEEEGKGKDASGNKVKAEPAKIEAFRASLSKLGDVYVNDAFGTAHRAHSSMVGVNLPQKAGGFLMKKELNYFAKALESPERPFLAILGGAKVADKIQLINNMLDKVNEMIIGGGMAFTFLKVLNNMEIGTSLFDEEGAKIVKDLMSKAEKNGVKITLPVDFVTADKFDENAKTGQATVASGIPAGWMGLDCGPESSKKYAEAVTRAKQIVWNGPVGVFEWEAFARGTKALMDEVVKATSRGCITIIGGGDTATCCAKWNTEDKVSHVSTGGGASLELLEGKVLPGVDALSNI

SEQ ID NO: 120 - protein, 417 aa, Homo sapiens
SLSNKLTLDKLDVKGKRVVMRVDFNVPMKNNQITNNQRIKAAVPSIKFCLDNGAKSVVLMSHLGRPDGVPMPDKYSLEPVAVELKSLLGKDVLFLKDCVGPEVEKACANPAAGSVILLENLRFHVEEEGKGKDASGNKVKAEPAKIEAFRASLSKLGDVYVNDAFGTAHRAHSSMVGVNLPQKAGGFLMKKELNYFAKALESPERPFLAILGGAKVADKIQLINNMLDKVNEMIIGGGMAFTFLKVLNNMEIGTSLFDEEGAKIVKDLMSKAEKNGVKITLPVDFVTADKFDENAKTGQATVASGIPAGWMGLDCGPESSKKYAEAVTRAKQIVWNGPVGVFEWEAFARGTKALMDEVVKATSRGCITIIGGGDTATCCAKWNTEDKVSHVSTGGGASLELLEGKVLPGVDALSNIL

SEQ ID NO: 121 - protein, 241 aa, Homo sapiens
MQCFSFIKTMMILFNLLIFLCGAALLAVGIWVSIDGASFLKIFGPLSSSAMQFVNVGYFLIAAGVVVFALGFLGCYGAKTESKCALVTFFFILLLIFIAEVAAAVVALVYTTMAEHFLTLLVVPAIKKDYGSQEDFTQVWNTTMKGLKCCGFTNYTDFEDSPYFKENSAFPPFCCNDNVTNTANETCTKQKAHDQKVEGCFNQLLYDIRTNAVTVGGVAAGIGGLELAAMIVSMYLYCNLQ

SEQ ID NO: 122 - protein, 241 aa, Homo sapiens; identical to SEQ ID NO: 121

SEQ ID NO: 123 - protein, 241 aa, Homo sapiens; identical to SEQ ID NO: 121

SEQ ID NO: 124 - protein, 241 aa, Homo sapiens; identical to SEQ ID NO: 121

SEQ ID NO: 125 - protein, 241 aa, Homo sapiens; identical to SEQ ID NO: 121

SEQ ID NO: 126 - protein, 241 aa, Homo sapiens; identical to SEQ ID NO: 121

SEQ ID NO: 127 - protein, 640 aa, Homo sapiens
MALSRGLPRELAEAVAGGRVLVVGAGGIGCELLKNLVLTGFSHIDLIDLDTIDVSNLNRQFLFQKKHVGRSKAQVAKESVLQFYPKANIVAYHDSIMNPDYNVEFFRQFILVMNALDNRAARNHVNRMCLAADVPLIESGTAGYLGQVTTIKKGVTECYECHPKPTQRTFPGCTIRNTPSEPIHCIVWAKYLFNQLFGEEDADQEVSPDRADPEAAWEPTEAEARARASNEDGDIKRISTKEWAKSTGYDPVKLFTKLFKDDIRYLLTMDKLWRKRKPPVPLDWAEVQSQGEETNASDQQNEPQLGLKDQQVLDVKSYARLFSKSIETLRVHLAEKGDGAELIWDKDDPSAMDFVTSAANLRMHIFSMNMKSRFDIKSMAGNIIPAIATTNAVIAGLIVLEGLKILSGKIDQCRTIFLNKQPNPRKKLLVPCALDPPNPNCYVCASKPEVTVRLNVHKVTVLTLQDKIVKEKFAMVAPDVQIEDGKGTILISSEEGETEANNHKKLSEFGIRNGSRLQADDFLQDYTLLINILHSEDLGKDVEFEVVGDAPEKVGPKQAEDAAKSITNGSDDGAQPSTSTAQEQDDVLIVDSDEEDSSNNADVSEEERSRKRKLDEKENLSAKRSRIEQKEELDDVIALD

SEQ ID NO: 128 - protein, 640 aa, Homo sapiens; identical to SEQ ID NO: 127

SEQ ID NO: 129 - protein, 640 aa, Homo sapiens; identical to SEQ ID NO: 127

SEQ ID NO: 130 - protein, 499 aa, Homo sapiens
MELSEPIVENGETEMSPEESWEHKEEISEAEPGGGSLGDGRPPEESAHEMMEEEEEIPKPKSVVAPPGAPKKEHVNVVFIGHVDAGKSTIGGQIMYLTGMVDKRTLEKYEREAKEKNRETWYLSWALDTNQEERDKGKTVEVGRAYFETEKKHFTILDAPGHKSFVPNMIGGASQADLAVLVISARKGEFETGFEKGGQTREHAMLAKTAGVKHLIVLINKMDDPTVNWSNERYEECKEKLVPFLKKVGFNPKKDIHFMPCSGLTGANLKEQSDFCPWYIGLPFIPYLDNLPNFNRSVDGPIRLPIVDKYKDMGTVVLGKLESGSICKGQQLVMMPNKHNVEVLGILSDDVETDTVAPGENLKIRLKGIEEEEILPGFILCDPNNLCHSGRTFDAQIVIIEHKSIICPGYNAVLHIHTCIEEVEITALICLVDKKSGEKSKTRPRFVKQDQVCIARLRTAGTICLETFKDFPQMGRFTLRDEGKTIAIGKVLKLVPEKD

SEQ ID NO: 131 - protein, 499 aa, Homo sapiens; identical to SEQ ID NO: 130

SEQ ID NO: 132 - protein, 637 aa, Homo sapiens
MDPGSGGGGGGGGGGGSSSGSSSSDSAPDCWDQADMEAPGPGPCGGGGSLAAAAEAQRENLSAAFSRQLNVNAKPFVPNVHAAEFVPSFLRGPAAPPPPAGGAANNHGAGSGAGGRAAPVESSQEEQSLCEGSNSAVSMELSEPIVENGETEMSPEESWEHKEEISEAEPGGGSLGDGRPPEESAHEMMEEEEEIPKPKSVVAPPGAPKKEHVNVVFIGHVDAGKSTIGGQIMYLTGMVDKRTLEKYEREAKEKNRETWYLSWALDTNQEERDKGKTVEVGRAYFETEKKHFTILDAPGHKSFVPNMIGGASQADLAVLVISARKGEFETGFEKGGQTREHAMLAKTAGVKHLIVLINKMDDPTVNWSNERYEECKEKLVPFLKKVGFNPKKDIHFMPCSGLTGANLKEQSDFCPWYIGLPFIPYLDNLPNFNRSVDGPIRLPIVDKYKDMGTVVLGKLESGSICKGQQLVMMPNKHNVEVLGILSDDVETDTVAPGENLKIRLKGIEEEEILPGFILCDPNNLCHSGRTFDAQIVIIEHKSIICPGYNAVLHIHTCIEEVEITALICLVDKKSGEKSKTRPRFVKQDQVCIARLRTAGTICLETFKDFPQMGRFTLRDEGKTIAIGKVLKLVPEKD

SEQ ID NO: 133 - protein, 628 aa, Homo sapiens
MDSGSSSSDSAPDCWDQVDMESPGLAPSGDGVSSAVAEAQREPLSSAFSRKLNVNAKPFVPNVHAAEFVPSFLRGPTQPPTLPAGSGSNDETCTGAGYPQGKRMGRGAPVEPSREEPLASLEGSNSAVTMELSEPVVENGEVEMALEESWEHSKEVSEAEPGGGSSGDSGPPEESGQEMMEEKEEIRKSKSVIVPSGAPKKEHVNVVFIGHVDAGKSTIGGQIMFLTGMVDKRTLEKYEREAKEKNRETWYLSWALDTNQEERDKGKTVEVGRAYFETERKHFTILDAPGHKGFVPNMIGGASQADLAVLVISARKGEFETGFEKGGQTREHAMLAKTAGVKHLIVLINKMDDPTVNWSIERYEECKEKLVPFLKKVGFSPKKDIHFMPCSGLTGANIKEQSDFCPWYTGLPFIPYLDNLPNFNRSIDGPIRLPIVDKYKDMGTVVLGKLESGSIFKGQQLVMMPNKHNVEVLGILSDDTETDFVAPGENLKIRLKGIEEEEILPGFILCDPSNLCHSGRTFDVQIVIIEHKSIICPGYNAVLHIHTCIEEVEITALISLVDKKSGEKSKTRPRFVKQDQVCIARLRTAGTICLETFKDFPQMGRFTLRDEGKTIAIGKVLKLVPEKD

SEQ ID NO: 134 - protein, 628 aa, Homo sapiens
MDSGSSSSDSAPDCWDQVDMESPGSAPSGDGVSSAVAEAQREPLSSAFSRKLNVNAKPFVPNVHAAEFVPSFLRGPTQPPTLPAGSGSNDETCTGAGYPQGKRMGRGAPVEPSREEPLVSLEGSNSAVTMELSEPVVENGEVEMALEESWEHSKEVSEAEPGGGSSGDSGPPEESGQEMMEEKEEIRKSKSVIVPSGAPKKEHVNVVFIGHVDAGKSTIGGQIMFLTGMVDKRTLEKYEREAKEKNRETWYLSWALDTNQEERDKGKTVEVGRAYFETERKHFTILDAPGHKSFVPNMIGGASQADLAVLVISARKGEFETGFEKGGQTREHAMLAKTAGVKHLIVLINKMDDPTVNWSIERYEECKEKLVPFLKKVGFSPKKDIHFMPCSGLTGANIKEQSDFCPWYTGLPFIPYLDNLPNFNRSIDGPIRLPIVDKYKDMGTVVLGKLESGSIFKGQQLVMMPNKHNVEVLGILSDDTETDFVAPGENLKIRLKGIEEEEILPGFILCDPSNLCHSGRTFDVQIVIIEHKSIICPGYNAVLHIHTCIEEVEITALISLVDKKSGEKSKTRPRFVKQDQVCIARLRTAGTICLETFKDFPQMGRFTLRDEGKTIAIGKVLKLVPEKD

SEQ ID NO: 135 - protein, 237 aa, Homo sapiens
MAGVSACIKYSMFTFNFLFWLCGILILALAIWVRVSNDSQAIFGSEDVGSSSYVAVDILIAVGAIIMILGFLGCCGAIKESRCMLLLFFIGLLLILLLQVATGILGAVFKSKSDRIVNETLYENTKLLSATGESEKQFQEAIIVFQEEFKCCGLVNGAADWGNNFQHYPELCACLDKQRPCQSYNGKQVYKETCISFIKDFLAKNLIIVIGISFGLAVIEILGLVFSMVLYCQIGNK

SEQ ID NO: 136 - protein, 237 aa, Homo sapiens; identical to SEQ ID NO: 135

SEQ ID NO: 137 - protein, 237 aa, Homo sapiens; identical to SEQ ID NO: 135

SEQ ID NO: 138 - protein, 237 aa, Homo sapiens; identical to SEQ ID NO: 135

SEQ ID NO: 139 - protein, 395 aa, Homo sapiens
MIKKFDKKDEESGSGSNPFQHLEKSAVLQEARIFNETPINPRRCLHILTKILYLLNQGEHFGTTEATEAFFAMTRLFQSNDQTLRRMCYLTIKEMATISEDVIIVTSSLTKDMTGKEDVYRGPAIRALCRITDGTMLQAIERYMKQAIVDKVSSVSSSALVSSLHMMKISYDVVKRWINEAQEAASSDNIMVQYHALGVLYHLRKNDRLAVSKMLNKFTKSGLKSQFAYCMLIRIASRLLKETEDGCTMKFTVRDCDPNTGVPDEDGYDDEYVLEDLEVTVSDHIQKVLKPNFAAAWEEVGDTFEKEETFALSSTKTLEEAVNNIITFLGMQPCERSDKVPENKNSHSLYLAGIFRGGYDLLVRSRLALADGVTMQVTVRSKERTPVDVILASVG

SEQ ID NO: 140 - protein, 874 aa, Homo sapiens
MLKKFDKKDEESGGGSNPFQHLEKSAVLQEARVFNETPINPRKCAHILTKILYLINQGEHLGTTEATEAFFAMTKLFQSNDPTLRRMCYLTIKEMSCIAEDVIIVTSSLTKDMTGKEDNYRGPAVRALCQITDSTMLQAIERYMKQAIVDKVPSVSSSALVSSLHLLKCSFDVVKRWVNEAQEAASSDNIMVQYHALGLLYHVRKNDRLAVNKMISKVTRHGLKSPFAYCMMIRVASKQLEEEDGSRDSPLFDFIESCLRNKHEMVVYEAASAIVNLPGCSAKELAPAVSVLQLFCSSPKAALRYAAVRTLNKVAMKHPSAVTACNLDLENLVTDSNRSIATLAITTLLKTGSESSIDRLMKQISSFMSEISDEFKVVVVQAISALCQKYPRKHAVLMNFLFTMLREEGGFEYKRAIVDCIISIIEENSESKETGLSHLCEFIEDCEFTVLATRILHLLGQEGPKTTNPSKYIRFIYNRVVLEHEEVRAGAVSALAKFGAQNEEMLPSILVLLKRCVMDDDNEVRDRATFYLNVLEQKQKALNAGYILNGLTVSIPGLERALQQYTLEPSEKPFDLKSVPLATAPMAEQRTESTPITAVKQPEKVAATRQEIFQEQLAAVPEFRGLGPLFKSSPEPVALTESETEYVIRCTKHTFTNHMVFQFDCTNTLNDQTLENVTVQMEPTEAYEVLCYVPARSLPYNQPGTCYTLVALPKEDPTAVACTFSCMMKFTVKDCDPTTGETDDEGYEDEYVLEDLEVTVADHIQKVMKLNFEAAWDEVGDEFEKEETFTLSTIKTLEEAVGNIVKFLGMHPCERSDKVPDNKNTHTLLLAGVFRGGHDILVRSRLLLLDTVTMQVTARSLEELPVDIILASVG

SEQ ID NO: 141 - protein, 871 aa, Homo sapiens
MIKKFDKKDEESGSGSNPFQHLEKSAVLQEARIFNETPINPRRCLHILTKILYLLNQGEHFGTTEATEAFFAMTRLFQSNDQTLRRMCYLTIKEMATISEDVIIVTSSLTKDMTGKEDVYRGPAIRALCRITDGTMLQAIERYMKQAIVDKVSSVSSSALVSSLHMMKISYDVVKRWINEAQEAASSDNIMVQYHALGVLYHLRKNDRLAVSKMLNKFTKSGLKSQFAYCMLIRIASRLLKETEDGHESPLFDFIESCLRNKHEMVIYEAASAIIHLPNCTARELAPAVSVLQLFCSSPKPALRYAAVRTLNKVAMKHPSAVTACNLDLENLITDSNRSIATLAITTLLKTGSESSVDRLMKQISSFVSEISDEFKVVVVQAISALCQKYPRKHSVMMTFLSNMLRDDGGFEYKRAIVDCIISIVEENPESKEAGLAHLCEFIEDCEHTVLATKILHLLGKEGPRTPVPSKYIRFIFNRVVLENEAVRAAAVSALAKFGAQNESLLPSILVLLQRCMMDTDDEVRDRATFYLNVLQQRQMALNATYIFNGLTVSVPGMEKALHQYTLEPSEKPFDMKSIPLAMAPVFEQKAEITLVATKPEKLAPSRQDIFQEQLAAIPEFLNIGPLFKSSEPVQLTEAETEYFVRCIKHMFTNHIVFQFDCTNTLNDQLLEKVTVQMEPSDSYEVLSCIPAPSLPYNQPGICYTLVRLPDDDPTAVAGSFSCTMKFTVRDCDPNTGVPDEDGYDDEYVLEDLEVTVSDHIQKVLKPNFAAAWEEVGDTFEKEETFALSSTKTLEEAVNNIITFLGMQPCERSDKVPENKNSHSLYLAGIFRGGYDLLVRSRLALADGVTMQVTVRSKERTPVDVILASVG

SEQ ID NO: 142 - protein, 871 aa, Homo sapiens; identical to SEQ ID NO: 141

SEQ ID NO: 143 - protein, 439 aa, Homo sapiens
MIKKFDKKDEESGSGSNPFQHLEKSAVLQEARIFNETPINPRRCLHILTKILYLLNQGEHFGTTEATEAFFAMTRLFQSNDQTLRRMCYLTIKEMATISEDVIIVTSSLTKDMTGKEDVYRGPAIRALCRITDGTMLQAIERYMKQAIVDKVSSVSSSALVSSLHMMKISYDVVKRWINEAQEAASSDNIMVQYHALGVLYHLRKNDRLAVSKMLNKFTKSGLKSQFAYCMLIRIASRLLKETEDGTIPPSLSEFVLEKNSLPPFVQHSHRLNTIFQVCLPSPPVAGSFSCTMKFTVRDCDPNTGVPDEDGYDDEYVLEDLEVTVSDHIQKVLKPNFAAAWEEVGDTFEKEETFALSSTKTLEEAVNNIITFLGMQPCERSDKVPENKNSHSLYLAGIFRGGYDLLVRSRLALADGVTMQVTVRSKERTPVDVILASVG

SEQ ID NO: 144 - protein, 874 aa, Homo sapiens; identical to SEQ ID NO: 140

SEQ ID NO: 145 - protein, 307 aa, Homo sapiens
MSSSYWSETSSSSCGTQQLPEVLQCQPQHYHCYHQSSQAQQPPEKNVVYERVRTYSGPMNKVVQALDPFNSREVLSPLKTTSSYQNLVWSDHSQELHSPTLKISTCAPSTLHITQNTEQELHSPTVKLTTYPQTTIRKYVVQNPEQEPLSQFLRGSHFFPGNNVIYEKTIRKVEKLNTDQGCHPQAQCHHHIIQQPQVIHSAHWQQPDSSQQIQAITGNNPISTHIGNELCHSGSSQICEQVIIQDDGPEKLDPRYFGELLADLSRKNTDLYHCLLEHLQRIGGRKQSLSSTYTIRHGIQTKRTGIL

SEQ ID NO: 146 - protein, 589 aa, Homo sapiens [sequence omitted]

SEQ ID NO: 147 - protein, 595 aa, Homo sapiens [sequence omitted]

SEQ ID NO: 148 - protein, 169 aa, Homo sapiens
MVPAVAVVKKDSGFQMNQLRGKKSCHTGLGRSAGWNIPIGLLYCDLPEPRKPLEKAVANFFSGSCAPCADGTDFPQLCQLCPGCGCSTLNQYFGYSGAFKCLKDGAGDVAFVKHSTIFENLANKADRDQYELLCLDNTRKPVDEYKDCHLAQVPSHTVVARSMGGKEDL

SEQ ID NO: 149 - protein, 698 aa, Homo sapiens
MRLAVGALLVCAVLGLCLAVPDKTVRWCAVSEHEATKCQSFRDHMKSVIPSDGPSVACVKKASYLDCIRAIAANEADAVTLDAGLVYDAYLAPNNLKPVVAEFYGSKEDPQTFYYAVAVVKKDSGFQMNQLRGKKSCHTGLGRSAGWNIPIGLLYCDLPEPRKPLEKAVANFFSGSCAPCADGTDFPQLCQLCPGCGCSTLNQYFGYSGAFKCLKDGAGDVAFVKHSTIFENLANKADRDQYELLCLDNTRKPVDEYKDCHLAQVPSHTVVARSMGGKEDLIWELLNQAQEHFGKDKSKEFQLFSSPHGKDLLFKDSAHGFLKVPPRMDAKMYLGYEYVTAIRNLREGTCPEAPTDECKPVKWCALSHHERLKCDEWSVNSVGKIECVSAETTEDCIAKIMNGEADAMSLDGGFVYIAGKCGLVPVLAENYNKSDNCEDTPEAGYFAVAVVKKSASDLTWDNLKGKKSCHTAVGRTAGWNIPMGLLYNKINHCRFDEFFSEGCAPGSKKDSSLCKLCMGSGLNLCEPNNKEGYYGYTGAFRCLVEKGDVAFVKHQTVPQNTGGKNPDPWAKNLNEKDYELLCLDGTRKPVEEYANCHLARAPNHAVVTRKDKEACVHKILRQQQHLFGSNVTDCSGNFCLFRSETKDLLFRDDTVCLAKLHDRNTYEKYLGEEYVKAVGNLRKCSTSSLLEACTFRRP

SEQ ID NO: 150 - protein, 698 aa, Homo sapiens; identical to SEQ ID NO: 149

SEQ ID NO: 151 - protein, 571 aa, Homo sapiens
MNQLRGKKSCHTGLGRSAGWNIPIGLLYCDLPEPRKPLEKAVANFFSGSCAPCADGTDFPQLCQLCPGCGCSTLNQYFGYSGAFKCLKDGAGDVAFVKHSTIFENLANKADRDQYELLCLDNTRKPVDEYKDCHLAQVPSHTVVARSMGGKEDLIWELLNQAQEHFGKDKSKEFQLFSSPHGKDLLFKDSAHGFLKVPPRMDAKMYLGYEYVTAIRNLREGTCPEAPTDECKPVKWCALSHHERLKCDEWSVNSVGKIECVSAETTEDCIAKIMNGEADAMSLDGGFVYIAGKCGLVPVLAENYNKSDNCEDTPEAGYFAVAVVKKSASDLTWDNLKGKKSCHTAVGRTAGWNIPMGLLYNKINHCRFDEFFSEGCAPGSKKDSSLCKLCMGSGLNLCEPNNKEGYYGYTGAFRCLVEKGDVAFVKHQTVPQNTGGKNPDPWAKNLNEKDYELLCLDGTRKPVEEYANCHLARAPNHAVVTRKDKEACVHKILRQQQHLFGSNVTDCSGNFCLFRSETKDLLFRDDTVCLAKLHDRNTYEKYLGEEYVKAVGNLRKCSTSSLLEACTFRRP

SEQ ID NO: 152 - protein, 105 aa, Homo sapiens
MCQGGDFTRHNGTGGKSIYGEKFEDENFILKHTGPGILSMANAGPNTNGSQFFICTAKTEWLDGKHVVFGKVKEGMNIVEAMERFGSRNGKTSKKITIADCGQLE

SEQ ID NO: 153 - protein, 125 aa, Homo sapiens
MGEKGFGCKGSRFHRIIPGFMCQGGDFTRHNGTGGKSIYGEKFDDENFILKHTGPGILSMANAGPNTNGSQFFICTAKSEWLDGKHVVFGKMKEGINIVEATGRFGSRNGKTSKKITIADCGQLE

SEQ ID NO: 154 - protein, 105 aa, Homo sapiens [sequence omitted]

SEQ ID NO: 155 - protein, 113 aa, Homo sapiens
SHHNGTGGKSIYTEKFEDENFILKHTGPGILSMANAGPNTNGSQFFICTAKSEWLDGKHVLFGKVKEGTNIVEAWSALGPGMARPARRSPLLTVDNSNKFDLCFILTTRPFLP

SEQ ID NO: 156 - protein, 164 aa, Homo sapiens
VNPTVFFDIAVDGEPLGRVSFELFADKVPKTAENFRALSTGEKGFGYKGSCFHRIIPGFMCQGGDFTRHNGTGGKSIYGEKFEDENFILKHTGPGILSMANAGPNTNGSQFFICTAKTEWLDGKHVVFGKVKEGMNIVEAMERFGSRNGKTSKKITIADCGQLE

SEQ ID NO: 157 - protein, 165 aa, Homo sapiens
MVNPTVFFDIAVDGEPLGRVSFELFADKVPKTAENFRALSTGEKGFGYKGSCFHRIIPGFMCQGGDFTRHNGTGGKSIYGEKFEDENFILKHTGPGILSMANAGPNTNGSQFFICTAKTEWLDGKHVVFGKVKEGMNIVEAMERFGSRNGKTSKKITIADCGQLE

SEQ ID NO: 158 - protein, 118 aa, Homo sapiens [sequence omitted]

SEQ ID NO: 159 - protein, 105 aa, Homo sapiens; identical to SEQ ID NO: 152

SEQ ID NO: 160 - protein, 179 aa, Homo sapiens
MSGVWEGRSPVVSAIVNPTVFFNIAINGEPLGCISFELFADKFPKTAENLRVLGMGEKGFGCKGSRFHRIIPGFMCQGGDFTRHNGTGGKSIYGEKFDDENFILKHTGPGILSMANAGPNTNGSQFFICTAKSEWLDGKHVVFGKMKEGINIVEATGRFGSRNGKTSKKITIADCGQLE

SEQ ID NO: 161 - protein, 167 aa, Homo sapiens
MRRQPLDCVSFELFADKVSKTAENFRALSTGEKGFGCKGSCFHRIIPGFMCQGGDFTCHNGTGGKSIYWEKFDDENFILKHTGPGILSMANAGPNTNGSQFFICTAKTKWLDGKHVAFGKVKEGMNIVEAMEGPGMARPARRSPLLTVDNSNKFDLCFILTSRPFLL

SEQ ID NO: 162 - protein, 98 aa, Homo sapiens
LHTHNGTGGKSIYGEKFGDENFILKHTGPGILSMANAGPNTNGSQFFICTAKTEWLDGKHVVCGKAKEGKNIVEAMERCGSRNGKTSKKITIADCEQL

SEQ ID NO: 163 - protein, 165 aa, Homo sapiens [sequence omitted]

SEQ ID NO: 164 - protein, 158 aa, Homo sapiens
MRSSRTHISGTFFHDHLFADKFPKTAENFRALSTGEKGFSYKGSCFHRIIPGFMYQGRDFTRHNGTGGKSIYGEKFEDENFILKHTGPGILSMANAGPNTNGSQFFICTAKTEWLDGKHVVFGKVKEGMNIMEAMERFGSRNGKTSKKITIADCGQLE

SEQ ID NO: 165 - protein, 165 aa, Homo sapiens [sequence omitted]

SEQ ID NO: 166 - protein, 105 aa, Homo sapiens; identical to SEQ ID NO: 152

SEQ ID NO: 167 - protein, 232 aa, Homo sapiens
MCRPHQRRLPSIGQMHCHSGEVADPIGRDGGARPGCGRGRTWYKRGGRPGSCRFADATAEENRVLLAMVNPTVFFDIAVDGEPLGRVSFELFADKVPKTAENFRALSTGEKGFGYKGSCFHRIIPGFMCQGGDFTRHNGTGGKSIYGEKFEDENFILKHTGPGILSMANAGPNTNGSQFFICTAKTEWLDGKHVVFGKVKEGMNIVEAMERFGSRNGKTSKKITIADCGQLE

SEQ ID NO: 168 - protein, 187 aa, Homo sapiens
MCRPHQRRLPSIGQMHCHSGEVADPIGRDGGARPGCGRGRTWYKRGGRPGSCRFADATAEENRVLLAMVNPTVFFDIAVDGEPLGRVSFELFADKVPKTAENFRALSTGEKGFGYKGSCFHRIIPGFMCQGGDFTRHNGTGGKSIYGEKFEDENFILKHTGPGILSMANAGPNTNGSQFFICTAKTE

SEQ ID NO: 169 - protein, 200 aa, Homo sapiens
MAKKTYDLLFKLLLIGDSGVGKTCVLFRFSDDAFNTTFISTIGIDFKIKTVELQGKKIKLQIWDTAGQERFHTITTSYYRGAMGIMLVYDITNGKSFENISKWLRNIDEHANEDVERMLLGNKCDMDDKRVVPKGKGEQIAREHGIRFFETSAKANINIEKAFLTLAEDILRKTPVKEPNSENVDISSGGGVTGWKSKCC

SEQ ID NO: 170 - protein, 200 aa, Homo sapiens; identical to SEQ ID NO: 169

SEQ ID NO: 171 - protein, 200 aa, Homo sapiens; identical to SEQ ID NO: 169

SEQ ID NO: 172 - protein, 339 aa, Homo sapiens
MNWELLLWLLVLCALLLLLVQLLRFLRADGDLTLLWAEWQGRRPEWELTDMVVWVTGASSGIGEELAYQLSKLGVSLVLSARRVHELERVKRRCLENGNLKEKDILVLPLDLTDTGSHEAATKAVLQEFGRIDILVNNGGMSQRSLCMDTSLDVYRKLIELNYLGTVSLTKCVLPHMIERKQGKIVTVNSILGIISVPLSIGYCASKHALRGFFNGLRTELATYPGIIVSNICPGPVQSNIVENSLAGEVTKTIGNNGDQSHKMTTSRCVRLMLISMANDLKEVWISEQPFLLVTYLWQYMPTWAWWITNKMGKKRIENFKSGVDADSSYFKIFKTKHD

SEQ ID NO: 173 - protein, 339 aa, Homo sapiens; identical to SEQ ID NO: 172

SEQ ID NO: 174 - protein, 339 aa, Homo sapiens; identical to SEQ ID NO: 172

SEQ ID NO: 175 - protein, 521 aa, Homo sapiens
MADNEKLDNQRLKNFKNKGRDLETMRRQRNEVVVELRKNKRDEHLLKRRNVPHEDICEDSDIDGDYRVQNTSLEAIVQNASSDNQGIQLSAVQAARKLLSSDRNPPIDDLIKSGILPILVHCLERDDNPSLQFEAAWALTNIASGTSEQTQAVVQSNAVPLFLRLLHSPHQNVCEQAVWALGNIIGDGPQCRDYVISLGVVKPLLSFISPSIPITFLRNVTWVMVNLCRHKDPPPPMETIQEILPALCVLIHHTDVNILVDTVWALSYLTDAGNEQIQMVIDSGIVPHLVPLLSHQEVKVQTAALRAVGNIVTGTDEQTQVVLNCDALSHFPALLTHPKEKINKEAVWFLSNITAGNQQQVQAVIDANLVPMIIHLLDKGDFGTQKEAAWAISNLTISGRKDQVAYLIQQNVIPPFCNLLTVKDAQVVQVVLDGLSNILKMAEDEAETIGNLIEECGGLEKIEQLQNHENEDIYKLAYEIIDQFFSSDDIDEDPSLVPEAIQGGTFGFNSSANVPTEGFQF

SEQ ID NO: 176 - protein, 521 aa, Homo sapiens; identical to SEQ ID NO: 175

SEQ ID NO: 177 - protein, 521 aa, Homo sapiens; identical to SEQ ID NO: 175

SEQ ID NO: 178 - protein, 430 aa, Homo sapiens
MALLHSGRVLPGIAAAFHPGLAAAASARASSWWTHVEMGPPDPILGVTEAFKRDTNSKKMNLGVGAYRDDNGKPYVLPSVRKAEAQIAAKNLDKEYLPIGGLAEFCKASAELALGENSEVLKSGRFVTVQTISGTGALRIGASFLQRFFKFSRDVFLPKPTWGNHTPIFRDAGMQLQGYRYYDPKTCGFDFTGAVEDISKIPEQSVLLLHACAHNPTGVDPRPEQWKEIATVVKKRNLFAFFDMAYQGFASGDGDKDAWAVRHFIEQGINVCLCQSYAKNMGLYGERVGAFTMVCKDADEAKRVESQLKILIRPMYSNPPLNGARIAAAILNTPDLRKQWLQEVKGMADRIIGMRTQLVSNLKKEGSTHNWQHITDQIGMFCFTGLKPEQVERLIKEFSIYMTKDGRISVAGVTSSNVGYLAHAIHQVTK

SEQ ID NO: 179 - protein, 430 aa, Homo sapiens; identical to SEQ ID NO: 178

SEQ ID NO: 180 - protein, 430 aa, Homo sapiens; identical to SEQ ID NO: 178

SEQ ID NO: 181 - protein, 1071 aa, Homo sapiens
MPAIMTMLADHAARQLLDFSQKLDINLLDNVVNCLYHGEGAQQRMAQEVLTHLKEHPDAWTRVDTILEFSQNMNTKYYGLQILENVIKTRWKILPRNQCEGIKKYVVGLIIKTSSDPTCVEKEKVYIGKLNMILVQILKQEWPKHWPTFISDIVGASRTSESLCQNNMVILKLLSEEVFDFSSGQITQVKSKHLKDSMCNEFSQIFQLCQFVMENSQNAPLVHATLETLLRFLNWIPLGYIFETKLISTLIYKFLNVPMFRNVSLKCLTEIAGVSVSQYEEQFVTLFTLTMMQLKQMLPLNTNIRLAYSNGKDDEQNFIQNLSLFLCTFLKEHDQLIEKRLNLRETLMEALHYMLLVSEVEETEIFKICLEYWNHLAAELYRESPFSTSASPLLSGSQHFDVPPRRQLYLPMLFKVRLLMVSRMAKPEEVLVVENDQGEVVREFMKDTDSINLYKNMRETLVYLTHLDYVDTERIMTEKLHNQVNGTEWSWKNLNTLCWAIGSISGAMHEEDEKRFLVTVIKDLLGLCEQKRGKDNKAIIASNIMYIVGQYPRFLRAHWKFLKTVVNKLFEFMHETHDGVQDMACDTFIKIAQKCRRHFVQVQVGEVMPFIDEILNNINTIICDLQPQQVHTFYEAVGYMIGAQTDQTVQEHLIEKYMLLPNQVWDSIIQQATKNVDILKDPETVKQLGSILKTNVRACKAVGHPFVIQLGRIYLDMLNVYKCLSENISAAIQANGEMVTKQPLIRSMRTVKRETLKLISGWVSRSNDPQMVAENFVPPLLDAVLIDYQRNVPAAREPEVLSTMAIIVNKLGGHITAEIPQIFDAVFECTLNMINKDFEEYPEHRTNFFLLLQAVNSHCFPAFLAIPPTQFKLVLDSIIWAFKHTMRNVADTGLQILFTLLQNVAQEEAAAQSFYQTYFCDILQHIFSVVTDTSHTAGLTMHASILAYMFNLVEEGKISTSLNPGNPVNNQIFLQEYVANLLKSAFPHLQDAQVKLFVTGLFSLNQDIPAFKEHLRDFLVQIKEFAGEDTSDLFLEEREIALRQADEEKHKRQMSVPGIFNPHEIPEEMCD

SEQ ID NO: 182 - protein, 1071 aa, Homo sapiens; identical to SEQ ID NO: 181

SEQ ID NO: 183 - protein, 1071 aa, Homo sapiens; identical to SEQ ID NO: 181

SEQ ID NO: 184 - protein, 558 aa, Homo sapiens
MYRYLAKALLPSRAGPAALGSAANHSAALLGRGRGQPAAASQPGLALAARRHYSELVADREDDPNFFKMVEGFFDRGASIVEDKLVKDLRTQESEEQKRNRVRGILRIIKPCNHVLSLSFPIRRDDGSWEVIEGYRAQHSQHRTPCKGGIRYSTDVSVDEVKALASLMTYKCAVVDVPFGGAKAGVKINPKNYTENELEKITRRFTMELAKKGFIGPGVDVPAPDMNTGEREMSWIADTYASTIGHYDINAHACVTGKPISQGGIHGRISATGRGVFHGIENFINEASYMSILGMTPGFRDKTFVVQGFGNVGLHSMRYLHRFGAKCIAVGESDGSIWNPDGIDPKELEDFKLQHGSILGFPKAKPYEGSILEVDCDILIPAATEKQLTKSNAPRVKAKIIAEGANGPTTPEADKIFLERNILVIPDLYLNAGGVTVSYFEWLKNLNHVSYGRLTFKYERDSNYHLLLSVQESLERKFGKHGGTIPIVPTAEFQDSISGASEKDIVHSALAYTMERSARQIMHTAMKYNLGLDLRTAAYVNAIEKVFKVYSEAGVTFT

SEQ ID NO: 185 - protein, 478 aa, Homo sapiens
MYRYLVEDLRTRESEEQKRNRVRGILRIIKPCNHVLSLSFPIRRDDGSWEVIEGYRAQHSQHRTPCKGGIRYSTDVSVDEVKALASLMTYKCAVVDVPFGGAKAGVKINPKNYTDNELEKITRRFTMELAKKGFIGPGIDVPAPDMSTGEREMSWIADTYASTIGHYDINAHACVTGKPISQGGIHGRISATGRGVFHGIENFINEASYMSILGMTPGFGDKTFVVQGFGNVGLHSMRYLHRFGAKCIAVGESDGSIWNPDGIDPKELEDFKLQHGSILGFPKAKPYEGSILEADCDILIPAASEKQLTKSNAPRVKAKIIAEGANGPTTPEADKIFLERNIMVIPDLYLNAGGVTVSYFEWLKNLNHVSYGRLTFKYERDSNYHLLMSVQESLERKFGKHGGTIPIVPTAEFQDRISGASEKDIVHSGLAYTMERSARQIMRTAMKYNLGLDLRTAAYVNAIEKVFKVYNEAGVTFT

SEQ ID NO: 186 - protein, 475 aa, Homo sapiens
VASARGEGTAGQEQKRNRVRGILRIIKPCNHVLSLSFPIRRDDGSWEVIEGYRAQHSQHRTPCKGGIRYSTDVSVDEVKALASLMTYKCAVVDVPFGGAKAGVKINPKNYTDNELEKITRRFTMELAKKGFIGPGIDVPAPDMSTGEREMSWIADTYASTIGHYDINAHACVTGKPISQGGIHGRISATGRGVFHGIENFINEASYMSILGMTPGFGDKTFVVQGFGNVGLHSMRYLHRFGAKCIAVGESDGSIWNPDGIDPKELEDFKLQHGSILGFPKAKPYEGSILEADCDILIPAASEKQLTKSNAPRVKAKIIAEGANGPTTPEADKIFLERNIMVIPDLYLNAGGVTVSYFEWLKNLNHVSYGRLTFKYERDSNYHLLMSVQESLERKFGKHGGTIPIVPTAEFQDRISGASEKDIVHSGLAYTMERSARQIMRTAMKYNLGLDLRTAAYVNAIEKVFKVYNEAGVTFT

SEQ ID NO: 187 - protein, 558 aa, Homo sapiens; identical to SEQ ID NO: 184

SEQ ID NO: 188 - protein, 558 aa, Homo sapiens
MYRYLGEALLLSRAGPAALGSASADSAALLGWARGQPAAAPQPGLALAARRHYSEAVADREDDPNFFKMVEGFFDRGASIVEDKLVEDLRTRESEEQKRNRVRGILRIIKPCNHVLSLSFPIRRDDGSWEVIEGYRAQHSQHRTPCKGGIRYSTDVSVDEVKALASLMTYKCAVVDVPFGGAKAGVKINPKNYTDNELEKITRRFTMELAKKGFIGPGIDVPAPDMSTGEREMSWIADTYASTIGHYDINAHACVTGKPISQGGIHGRISATGRGVFHGIENFINEASYMSILGMTPGFGDKTFVVQGFGNVGLHSMRYLHRFGAKCIAVGESDGSIWNPDGIDPKELEDFKLQHGSILGFPKAKPYEGSILEADCDILIPAASEKQLTKSNAPRVKAKIIAEGANGPTTPEADKIFLERNIMVIPDLYLNAGGVTVSYFEWLKNLNHVSYGRLTFKYERDSNYHLLMSVQESLERKFGKHGGTIPIVPTAEFQDRISGASEKDIVHSGLAYTMERSARQIMRTAMKYNLGLDLRTAAYVNAIEKVFKVYNEAGVTFT

SEQ ID NO: 189 - protein, 558 aa, Homo sapiens; identical to SEQ ID NO: 188

SEQ ID NO: 190 - protein, 492 aa, Homo sapiens
PGGPAPWLAPCPQSPSSPLGGAQGEGTAGQQKRNRVRGILRIIKPCNHVLSLSFPIRRDDGSWEVIEGYRAQHSQHRTPCKGGIRYSTDVSVDEVKALASLMTYKCAVVDVPFGGAKAGVKINPKNYTENELEKITRRFTMELAKKGFIGPGVDVPAPDMNTGEREMSWIADTYASTIGHYDINAHACVTGKPISQGGIHGRISATGRGVFHGIENFINEASYMSILGMTPGFRDKTFVVQGFGNVGLHSMRYLHRFGAKCIAVGESDGSIWNPDGIDPKELEDFKLQHGSILGFPKAKPYEGSILEVDCDILIPAATEKQLTKSNAPRVKAKIIAEGANGPTTPEADKIFLERNILVIPDLYLNAGGVTVSYFEWLKNLNHVSYGRLTFKYERDSNYHLLLSVQESLERKFGKHGGTIPIVPTAEFQDSISGASEKDIVHSALAYTMERSARQIMHTAMKYNLGLDLRTAAYVNAIEKVFKVYSEAGVTFT

SEQ ID NO: 191 - protein, 558 aa, Homo sapiens; identical to SEQ ID NO: 188

SEQ ID NO: 192 - protein, 554 aa, Homo sapiens [sequence omitted]

SEQ ID NO: 193 - protein, 939 aa, Homo sapiens
MPAVSKGDGMRGLAVFISDIRNCKSKEAEIKRINKELANIRSKFKGDKALDGYSKKKYVCKLLFIFLLGHDIDFGHMEAVNLLSSNRYTEKQIGYLFISVLVNSNSELIRLINNAIKNDLASRNPTFMGLALHCIASVGSREMAEAFAGEIPKVLVAGDTMDSVKQSAALCLLRLYRTSPDLVPMGDWTSRVVHLLNDQHLGVVTAATSLITTLAQKNPEEFKTSVSLAVSRLSRIVTSASTDLQDYTYYFVPAPWLSVKLLRLLQCYPPPDPAVRGRLTECLETILNKAQEPPKSKKVQHSNAKNAVLFEAISLIIHHDSEPNLLVRACNQLGQFLQHRETNLRYLALESMCTLASSEFSHEAVKTHIETVINALKTERDVSVRQRAVDLLYAMCDRSNAPQIVAEMLSYLETADYSIREEIVLKVAILAEKYAVDYTWYVDTILNLIRIAGDYVSEEVWYRVIQIVINRDDVQGYAAKTVFEALQAPACHENLVKVGGYILGEFGNLIAGDPRSSPLIQFHLLHSKFHLCSVPTRALLLSTYIKFVNLFPEVKPTIQDVLRSDSQLRNADVELQQRAVEYLRLSTVASTDILATVLEEMPPFPERESSILAKLKKKKGPSTVTDLEDTKRDRSVDVNGGPEPAPASTSAVSTPSPSADLLGLGAAPPAPAGPPPSSGGSGLLVDVFSDSASVVAPLAPGSEDNFARFVCKNNGVLFENQLLQIGLKSEFRQNLGRMFIFYGNKTSTQFLNFTPTLICSDDLQPNLNLQTKPVDPTVEGGAQVQQVVNIECVSDFTEAPVLNIQFRYGGTFQNVSVQLPITLNKFFQPTEMASQDFFQRWKQLSNPQQEVQNIFKAKHPMDTEVTKAKIIGFGSALLEEVDPNPANFVGAGIIHTKTTQIGCLLRLEPNLQAQMYRLTLRTSKEAVSQRLCELLSAQF

SEQ ID NO: 194 - protein, 128 aa, Homo sapiens
MGIQGGSVLFGLLLVLAVFCHSGHSLQCYNCPNPTADCKTAVNCSSDFDACLITKAGLQVYNKCWKFEHCNFNDVTTRLRENELTYYCCKKDLCNFNEQLENGGTSLSEKTVLLLVTPFLAAAWSLHP

SEQ ID NO: 195 - protein, 155 aa, Homo sapiens
MRGLSAEAARGWKRILGAARFCGQSQWESKEGLSCSGCCSSWLSSAIQVSHSLQCYNCPNPTADCKTAVNCSSDFDACLITKAGLQVYNKCWKFEHCNFNDVTTRLRENELTYYCCKKDLCNFNEQLENGGTSLSEKTVLLLVTPFLAAAWSLHP

SEQ ID NO: 196 - protein, 128 aa, Homo sapiens; identical to SEQ ID NO: 194

SEQ ID NO: 197 - protein, 128 aa, Homo sapiens; identical to SEQ ID NO: 194

SEQ ID NO: 198 - protein, 390 aa, Homo sapiens
MAPPQVLAFGLLLAAATATFAAAQEGEARIGAELWSWAGLGGSGPRPSAPETGIIGRGPRGRAFQRGDRTVRPCSGSGPPRGRKRRGPSRGAASLRSFARLECVCENYKLAVNCFVNNNRQCQCTSVGAQNTVICSKLAAKCLVMKAEMNGSKLGRRAKPEGALQNNDGLYDPDCDESGLFKAKQCNGTSMCWCVNTAGVRRTDKDTEITCSERVRTYWIIIELKHKAREKPYDSKSLRTALQKEITTRYQLDPKFITSILYENNVITIDLVQNSSQKTQNDVDIADVAYYFEKDVKGESLFHSKKMDLTVNGEQLDLDPGQTLIYYVDEKAPEFSMQGLKAGVIAVIVVVVIAVVAGIVVLVISRKKRMAKYEKAEIKEMGEMHRELNA

SEQ ID NO: 199 - protein, 314 aa, Homo sapiens
MAPPQVLAFGLLLAAATATFAAAQEECVCENYKLAVNCFVNNNRQCQCTSVGAQNTVICSKLAAKCLVMKAEMNGSKLGRRAKPEGALQNNDGLYDPDCDESGLFKAKQCNGTSMCWCVNTAGVRRTDKDTEITCSERVRTYWIIIELKHKAREKPYDSKSLRTALQKEITTRYQLDPKFITSILYENNVITIDLVQNSSQKTQNDVDIADVAYYFEKDVKGESLFHSKKMDLTVNGEQLDLDPGQTLIYYVDEKAPEFSMQGLKAGVIAVIVVVVIAVVAGIVVLVISRKKRMAKYEKAEIKEMGEMHRELNA

SEQ ID NO: 200 - protein, 314 aa, Homo sapiens [sequence omitted]

SEQ ID NO: 201 - protein, 216 aa, Homo sapiens
MLRLSERNMKVLLAAALIAGSVFFLLLPGPSAADEKKKGPKVTVKVYFDLRIGDEDVGRVIFGLFGKTVPKTVDNFVALATGEKGFGYKNSKFHRVIKDFMIQGGDFTRGDGTGGKSIYGERFPDENFKLKHYGPGWVSMANAGKDTNGSQFFITTVKTAWLDGKHVVFGKVLEGMEVVRKVESTKTDSRDKPLKDVIIADCGKIEVEKPFAIAKE

SEQ ID NO: 202 - protein, 216 aa, Homo sapiens; identical to SEQ ID NO: 201

SEQ ID NO: 203 - protein, 208 aa, Homo sapiens
MKVLLAAALIAGSVFFLLLPGPSAADEKKKGPKVTVKVYFDLRIGDEDVGRVIFGLFGKTVPKTVDNFVALATGEKGFGYKNSKFHRVIKDFMIQGGDFTRGDGTGGKSIYGERFPDENFKLKHYGPGWVSMANAGKDTNGSQFFITTVKTAWLDGKHVVFGKVLEGMEVVRKVESTKTDSRDKPLKDVIIADCGKIEVEKPFAIAKE

SEQ ID NO: 204 - protein, 216 aa, Homo sapiens; identical to SEQ ID NO: 201

SEQ ID NO: 205 - protein, 491 aa, Homo sapiens
MKRMVSWSFHKLKTMKHLLLLLLCVFLVKSQGVNDNEEGFFSARGHRPLDKKREEAPSLRPAPPPISGGGYRARPAKAAATQKKVERKAPDAGGCLHADPDLGVLCPTGCQLQEALLQQERPIRNSVDELNNNVEAVSQTSSSSFQYMYLLKDLWQKRQKQVKDNENVVNEYSSELEKHQLYIDETVNSNIPTNLRVLRSILENLRSKIQKLESDVSAQMEYCRTPCTVSCNIPVVSGKECEEIIRKGGETSEMYLIQPDSSVKPYRVYCDMNTENGGWTVIQNRQDGSVDFGRKWDPYKQGFGNVATNTDGKNYCGLPGEYWLGNDKISQLTRMGPTELLIEMEDWKGDKVKAHYGGFTVQNEANKYQISVNKYRGTAGNALMDGASQLMGENRTMTIHNGMFFSTYDRDNDGWLTSDPRKQCSKEDGGGWWYNRCHAANPNGRYYWGGQYTWDMAKHGTDDGVVWMNWKGSWYSMRKMSMKIRPFFPQQ

SEQ ID NO: 206 - protein, 391 aa, Homo sapiens
MKHLLLLLLCVFLVKSQGVNDNEEGFFSARGHRPLDKKREEAPSLRPAPPPISGGGYRARPAKAAATQKKVERKAPDAGGCLHAETVNSNIPTNLRVLRSILENLRSKIQKLESDVSAQMEYCRTPCTVSCNIPVVSGKECEEIIRKGGETSEMYLIQPDSSVKPYRVYCDMNTENGGWTVIQNRQDGSVDFGRKWDPYKQGFGNVATNTDGKNYCGLPGEYWLGNDKISQLTRMGPTELLIEMEDWKGDKVKAHYGGFTVQNEANKYQISVNKYRGTAGNALMDGASQLMGENRTMTIHNGMFFSTYDRDNDGWLTSDPRKQCSKEDGGGWWYNRCHAANPNGRYYWGGQYTWDMAKHGTDDGVVWMNWKGSWYSMRKMSMKIRPFFPQQ

SEQ ID NO: 207 - protein, 512 aa, Homo sapiens [sequence omitted]

SEQ ID NO: 208 - protein, 491 aa, Homo sapiens; identical to SEQ ID NO: 205

SEQ ID NO: 209 - protein, 344 aa, Homo sapiens
MYLLKDLWQKRQKQVKDNENVVNEYSSELEKHQLYIDETVNSNIPTNLRVLRSILENLRSKIQKLESDVSAQMEYCRTPCTVSCNIPVVSGKECEEIIRKGGETSEMYLIQPDSSVKPYRVYCDMNTENGGWTVIQNRQDGSVDFGRKWDPYKQGFGNVATNTDGKNYCGLPGEYWLGNDKISQLTRMGPTELLIEMEDWKGDKVKAHYGGFTVQNEANKYQISVNKYRGTAGNALMDGASQLMGENRTMTIHNGMFFSTYDRDNDGWLTSDPRKQCSKEDGGGWWYNRCHAANPNGRYYWGGQYTWDMAKHGTDDGVVWMNWKGSWYSMRKMSMKIRPFFPQQ

SEQ ID NO: 210 - protein, 257 aa, Homo sapiens [sequence omitted]

SEQ ID NO: 211 - protein, 344 aa, Homo sapiens; identical to SEQ ID NO: 209

SEQ ID NO: 212 - protein, 432 aa, Homo sapiens
MKRMVSWSFHKLKTMKHLLLLLLCVFLVKSQGVNDNEEGFFSARGHRPLDKKREEALLQQERPIRNSVDELNNNVEAVSQTSSSSFQYMYLLKDLWQKRQKQVKDNENVVNEYSSELEKHQLYIDETVNSNIPTNLRVLRSILENLRSKIQKLESDVSAQMEYCRTPCTVSCNIPVVSGKECEEIIRKGGETSEMYLIQPDSSVKPYRVYCDMNTENGGWTVIQNRQDGSVDFGRKWDPYKQGFGNVATNTDGKNYCGLPGEYWLGNDKISQLTRMGPTELLIEMEDWKGDKVKAHYGGFTVQNEANKYQISVNKYRGTAGNALMDGASQLMGENRTMTIHNGMFFSTYDRDNDGWLTSDPRKQCSKEDGGGWWYNRCHAANPNGRYYWGGQYTWDMAKHGTDDGVVWMNWKGSWYSMRKMSMKIRPFFPQQ

SEQ ID NO: 213 - protein, 491 aa, Homo sapiens
MKRMVSWSFHKLKTMKHLLLLLLCVFLVKSQGVNDNEEGFFSARGHRPLDKKREEAPSLRPAPPPISGGGYRARPAKAAATQKKVERKAPDAGGCLHADPDLGVLCPTGCQLQEALLQQERPIRNSVDELNNNVEAVSQTSSSSFQYMYLLKDLWQKRQKQVKDNENVVNEYSSELEKHQLYIDETVNSNIATNLRVLRSILENLRSKIQKLESDVSAQMEYCRTPCTVSCNIPVVSGKECEEIIRKGGETSEMYLIQPDSSVKPYRVYCDMNTENGGWTVIQNRQDGSVDFGRKWDPYKQGFGNVATNTDGKNYCGLPGEYWLGNDKISQLTRMGPTELLIEMEDWKGDKVKAHYGGFTVQNEANKYQISVNKYRGTAGNALMDGASQLMGENRTMTIHNGMFFSTYDRDNDGWLTSDPRKQCSKEDGGGWWYNRCHAANPNGRYYWGGQYTWDMAKHGTDDGVVWMNWKGSWYSMRKMSMKIRPFFPQQ

SEQ ID NO: 214 - protein, 445 aa, Homo sapiens [sequence omitted]

SEQ ID NO: 215 - protein, 457 aa, Homo sapiens
MKHLLLLLLCVFLVKSQGVNDNEEGFFSARGHRPLDKKREEAPSLRPAPPPISGGGYRARPAKAAATQKKLCPTGCQLQEALLQQERPIRNSVDELNNNVEAVSQTSSSSFQYMYLLKDLWQKRQKQVKDNENVVNEYSSELEKHQLYIDETVNSNIPTNLRVLRSILENLRSKIQKLESDVSAQMEYCRTPCTVSCNIPVVSGKECEEIIRKGGETSEMYLIQPDSSVKPYRVYCDMNTENGGWTVIQNRQDGSVDFGRKWDPYKQGFGNVATNTDGKNYCGLPGEYWLGNDKISQLTRMGPTELLIEMEDWKGDKVKAHYGGFTVQNEANKYQISVNKYRGTAGNALMDGASQLMGENRTMTIHNGMFFSTYDRDNDGWLTSDPRKQCSKEDGGGWWYNRCHAANPNGRYYWGGQYTWDMAKHGTDDGVVWMNWKGSWYSMRKMSMKIRPFFPQQ

SEQ ID NO: 216 - protein, 353 aa, Homo sapiens
GLAYVAAAGAAADAERGRPPGTSCGGRSGCGRRRARASERASEPSRASRRRHGPERPDGHGRGLRRPASVPHTPRPRTCLAAAWCSPPQPPHPWVSVALQFLRVTKQYLPHVARLCLISTFLEDGIRMWFQWSEQRDYIDTTWNCGYLLASSFVFLNLLGQLTGCVLVLSRNFVQYACFGLFGIIALQTIAYSILWDLKFLMRNLALGGGLLLLLAESRSEGKSMFAGVPTMRESSPKQYMQLGGRVLLVLMFMTLLHFDASFFSIVQNIVGTALMILVAIGFKTKLAALTLVVWLFAINVYFNAFWTIPVYKPMHDFLKYDFFQTMSVIGGLLLVVALGPGGVSMDEKKKEW

SEQ ID NO: 217 - protein, 269 aa, Homo sapiens
MGQNDLMGTAEDFADQFLRVTKQYLPHVARLCLISTFLEDGIRMWFQWSEQRDYIDTTWNCGYLLASSFVFLNLLGQLTGCVLVLSRNFVQYACFGLFGIIALQTIAYSILWDLKFLMRNLALGGGLLLLLAESRSEGKSMFAGVPTMRESSPKQYMQLGGRVLLVLMFMTLLHFDASFFSIVQNIVGTALMILVAIGFKTKLAALTLVVWLFAINVYFNAFWTIPVYKPMHDFLKYDFFQTMSVIGGLLLVVALGPGGVSMDEKKKEW

SEQ ID NO: 218 - protein, 333 aa, Homo sapiens
MISSDRVRASVHPWPHPAWPLEPQPTRSEAGRRALPVEAAAGAGADGREPASERASRAEPPAVAMGQNDLMGTAEDFADQFLRVTKQYLPHVARLCLISTFLEDGIRMWFQWSEQRDYIDTTWNCGYLLASSFVFLNLLGQLTGCVLVLSRNFVQYACFGLFGIIALQTIAYSILWDLKFLMRNLALGGGLLLLLAESRSEGKSMFAGVPTMRESSPKQYMQLGGRVLLVLMFMTLLHFDASFFSIVQNIVGTALMILVAIGFKTKLAALTLVVWLFAINVYFNAFWTIPVYKPMHDFLKYDFFQTMSVIGGLLLVVALGPGGVSMDEKKKEW

SEQ ID NO: 219 - protein, 269 aa, Homo sapiens; identical to SEQ ID NO: 217

SEQ ID NO: 220 - protein, 290 aa, Homo sapiens
NRRLASVPHTPRPRTCLAAAWCSPPQPPHPWVSVALQFLRVTKQYLPHVARLCLISTFLEDGIRMWFQWSEQRDYIDTTWNCGYLLASSFVFLNLLGQLTGCVLVLSRNFVQYACFGLFGIIALQTIAYSILWDLKFLMRNLALGGGLLLLLAESRSEGKSMFAGVPTMRESSPKQYMQLGGRVLLVLMFMTLLHFDASFFSIVQNIVGTALMILVAIGFKTKLAALTLVVWLFAINVYFNAFWTIPVYKPMHDFLKYDFFQTMSVIGGLLLVVALGPGGVSMDEKKKEW

SEQ ID NO: 221 - protein, 530 aa, Homo sapiens
GHLIVISFSSAFVSLGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQGTETPSVLQKHTTENVSATRTPPTPQKPTTVNVPATIVTPTPQKPTTINVPATGVSSTPQRHTIVNVSATGTLPTLQKPTRANDSATKSPAAAQTSFISKTLSTKTPSAAQNPMMTNASATQATLTAQKFTTAKVAFTQSPSAARKSTNVHSPVTNGLKSTQRFPSAHITATRSTPVSRTTKHFHETTPNKGSGTTSGTTRLLSALIMHMRATKYSMLCLTI

SEQ ID NO: 222 - protein, 381 aa, Homo sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGHTCFTLTGLLGTLVTMGLLT

SEQ ID NO: 223 - protein, 381 aa, Homo sapiens; identical to SEQ ID NO: 222

SEQ ID NO: 224 - protein, 321 aa, Homo sapiens
GHLIVISFSSAFVSLGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRATRSTPVSRTTKHFHETTPNKGSGTTSGTTRLLSGHTCFTLTGLLGTLVTMGLLT

SEQ ID NO: 225 - protein, 440 aa, Homo sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGSRPVTQAGMRWCDRSSLQSRTPGFKRSFHFSLPSSWYYRAHVFHVDRFAWDASNHGLADLAKEELRRKYTQVYRLFLVS

SEQ ID NO: 226 - protein, 507 aa, Homo sapiens
GHLIVISFSSAFVSLGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQGTETPSVLQKHTTENVSATRTPPTPQKPTTVNVPATIVTPTPQKPTTINVPATGVSSTPQRHTIVNVSATGTLPTLQKPTRANDSATKSPAAAQTSFISKTLSTKTPSAAQNPMMTNASATQATLTAQKFTTAKVAFTQSPSAAPTRSTPVSRTTKHFHETTPNKGSGTTSGTTRLLSGHTCFTLTGLLGTLVTMGLLT

SEQ ID NO: 227 - protein, 381 aa, Homo sapiens
MTVARPSVPAALPLLGELPRLLLLVLLCLPAVWGDCGLPPDVPNAQPALEGRTSFPEDTVITYKCEESFVKIPGEKDSVTCLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGHTCFTLTGLLGTLVTMGLLT

SEQ ID NO: 228 - protein, 193 aa, Homo sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTG

SEQ ID NO: 229 - protein, 363 aa, Homo sapiens
GHLIVISFSSAFVSLGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGHTCFTLTGLLGTLVTMGLLT

SEQ ID NO: 230 - protein, 376 aa, Homo sapiens
GHLIVISFSSAFVSLGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGQLTLFRFTEYGSNVLWWKYELDQDCRIKWSLIYCSQGFSY

SEQ ID NO: 231 - protein, 533 aa, Homo sapiens
GHLIVISFSSAFVSLGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQGTETPSVLQKHTTENVSATRTPPTPQKPTTVNVPATIVTPTPQKPTTINVPATGVSSTPQRHTIVNVSATGTLPTLQKPTRANDSATKSPAAAQTSFISKTLSTKTPSAAQNPMMTNASATQATLTAQKFTTAKVAFTQSPSAARKSTNVHSPVTNGLKSTQRFPSAHITATRSTPVSRTTKHFHETTPNKGSGTTSGTTRLLSGHTCFTLTGLLGTLVTMGLLT

SEQ ID NO: 232 - protein, 673 aa, Homo sapiens
MAKPAQGAKYRGSIHDFPGFDPNQDAEALYTAMKGFGSDKEAILDIITSRSNRQRQEVCQSYKSLYGKDLIADLKYELTGKFERLIVGLMRPPAYCDAKEIKDAISGIGTDEKCLIEILASRTNEQMHQLVAAYKDAYERDLEADIIGDTSGHFQKMLVVLLQGTREEDDVVSEDLVQQDVQDLYEAGELKWGTDEAQFIYILGNRSKQHLRLVFDEYLKTTGKPIEASIRGELSGDFEKLMLAVVKCIRSTPEYFAERLFKAMKGLGTRDNTLIRIMVSRSELDMLDIREIFRTKYEKSLYSMIKNDTSGEYKKTLLKLSGGDDDAAGQFFPEAAQVAYQMWELSAVARVELKGTVRPANDFNPDADAKALRKAMKGLGTDEDTIIDIITHRSNVQRQQIRQTFKSHFGRDLMTDLKSEISGDLARLILGLMMPPAHYDAKQLKKAMEGAGTDEKALIEILATRTNAEIRAINEAYKEDYHKSLEDALSSDTSGHFRRILISLATGHREEGGENLDQAREDAQVAAEILEIADTPSGDKTSLETRFMTILCTRSYPHLRRVFQEFIKMTNYDVEHTIKKEMSGDVRDAFVAIVQSVKNKPLFFADKLYKSMKGAGTDEKTLTRIMVSRSEIDLLNIRREFIEKYDKSLHQAIEGDTSGDFLKALLALCGGED

SEQ ID NO: 233 - protein, 667 aa, Homo sapiens
MAKPAQGAKYRGSIHDFPGFDPNQDAEALYTAMKGFGSDKEAILDIITSRSNRQRQEVCQSYKSLYGKDLIADLKYELTGKFERLIVGLMRPPAYCDAKEIKDAISGIGTDEKCLIEILASRTNEQMHQLVAAYKDAYERDLEADIIGDTSGHFQKMLVVLLQGTREEDDVVSEDLVQQDVQDLYEAGELKWGTDEAQFIYILGNRSKQHLRLVFDEYLKTTGKPIEASIRGELSGDFEKLMLAVVKCIRSTPEYFAERLFKAMKGLGTRDNTLIRIMVSRSELDMLDIREIFRTKYEKSLYSMIKNDTSGEYKKTLLKLSGGDDDAAGQFFPEAAQVAYQMWELSAVARVELKGTVRPANDFNPDADAKALRKAMKGLGTDEDTIIDIITHRSNVQRQQIRQTFKSHFGRDLMTDLKSEISGDLARLILGLMMPPAHYDAKQLKKAMEGAGTDEKALIEILATRTNAEIRAINEAYKEDYHKSLEDALSSDTSGHFRRILISLATGHREEGGENLDQAREDAQEIADTPSGDKTSLETRFMTILCTRSYPHLRRVFQEFIKMTNYDVEHTIKKEMSGDVRDAFVAIVQSVKNKPLFFADKLYKSMKGAGTDEKTLTRIMVSRSEIDLLNIRREFIEKYDKSLHQAIEGDTSGDFLKALLALCGGED

SEQ ID NO: 234 - protein, 667 aa, Homo sapiens
MAKPAQGAKYRGSIHDFPGFDPNQDAEALYTAMKGFGSDKEAILDIITSRSNRQRQEVCQSYKSLYGKDLIADLKYELTGKFERLIVGLMRPPAYCDAKEIKDAISGIGTDEKCLIEILASRTNEQMHQLVAAYKDAYERDLEADIIGDTSGHFQKMLVVLLQGTREEDDVVSEDLVQQDVQDLYEAGELKWGTDEAQFIYILGNRSKQHLRLVFDEYLKTTGKPMKASIRGELSGDFEKLMLAVVKCIRSTPEYFAERLFKAMKGLGTRDNTLIRIMVSRSELDMLDIREIFRTKYEKSLYSMIKNDTSGEYKKTLLKLSGGDDDAAGQFFPEAAQVAYQMWELSAVARVELKGTVRPANDFNPDADAKALRKAMKGLGTDEDTIIDIITHRSNVQRQQIRQTFKSHFGRDLMTDLKSEISGDLARLILGLMMPPAHYDAKQLKKAMEGAGTDEKALIEILATRTNAEIRAINEAYKEDYHKSLEDALSSDTSGHFRRILISLATGHREEGGENLDQAREDAQEIADTPSGDKTSLETRFMTILCTRTYPHLRRVFQEFIKMTNYDVEHTIKKEMSGDVRDAFVAIVQSVKNKPLFFADKLYKSMKGAGTDEKTLTRIMVSRSEIDLLNIRREFIEKYDKSLHQAIEGDTSGDFLKALLALCGGED

SEQ ID NO: 235 - protein, 673 aa, Homo sapiens; identical to SEQ ID NO: 232

SEQ ID NO: 236 - protein, 672 aa, Homo sapiens
AKPAQGAKYRGSIHDFPGFDPNQDAEALYTAMKGFGSDKEAILDIITSRSNRQRQEVCQSYKSLYGKDLIADLKYELTGKFERLIVGLMRPPAYCDAKEIKDAISGIGTDEKCLIEILASRTNEQMHQLVAAYKDAYERDLEADIIGDTSGHFQKMLVVLLQGTREEDDVVSEDLVQQDVQDLYEAGELKWGTDEAQFIYILGNRSKQHLRLVFDEYLKTTGKPIEASIRGELSGDFEKLMLAVVKCIRSTPEYFAERLFKAMKGLGTRDNTLIRIMVSRSELDMLDIREIFRTKYEKSLYSMIKNDTSGEYKKTLLKLSGGDDDAAGQFFPEAAQVAYQMWELSAVARVELKGTVRPANDFNPDADAKALRKAMKGLGTDEDTIIDIITHRSNVQRQQIRQTFKSHFGRDLMTDLKSEISGDLARLILGLMMPPAHYDAKQLKKAMEGAGTDEKALIEILATRTNAEIRAINEAYKEDYHKSLEDALSSDTSGHFRRILISLATGHREEGGENLDQAREDAQVAAEILEIADTPSGDKTSLETRFMTILCTRSYPHLRRVFQEFIKMTNYDVEHTIKKEMSGDVRDAFVAIVQSVKNKPLFFADKLYKSMKGAGTDEKTLTRIMVSRSEIDLLNIRREFIEKYDKSLHQAIEGDTSGDFLKALLALCGGED

SEQ ID NO: 237 - protein, 592 aa, Homo sapiens
MEGKWLLCMLLVLGTAIVEAHDGHDDDVIDIEDDLDDVIEEVEDSKPDTTAPPSSPKVTYKAPVPTGEVYFADSFDRGTLSGWILSKAKKDDTDDEIAKYDGKWEVEEMKESKLPGDKGLVLMSRAKHHAISAKLNKPFLFDTKPLIVQYEVNFQNGIECGGAYVKLLSKTPELNLDQFHDKTPYTIMFGPDKCGEDYKLHFIFRHKNPKTGIYEEKHAKRPDADLKTYFTDKKTHLYTLILNPDNSFEILVDQSVVNSGNLLNDMTPPVNPSREIEDPEDRKPEDWDERPKIPDPEAVKPDDWDEDAPAKIPDEEATKPEGWLDDEPEYVPDPDAEKPEDWDEDMDGEWEAPQIANPRCESAPGCGVWQRPVIDNPNYKGKWKPPMIDNPSYQGIWKPRKIPNPDFFEDLEPFRMTPFSAIGLELWSMTSDIFFDNFIICADRRIVDDWANDGWGLKKAADGAAEPGVVGQMIEAAEERPWLWVVYILTVALPVFLVILFCCSGKKQTSGMEYKKTDAPQPDVKEEEEEKEEEKDKGDEEEEGEEKLEEKQKSDAEEDGGTVSQEEEDRKPKAEEDEILNRSPRNRKPRRE

SEQ ID NO: 238 - protein, 592 aa, Homo sapiens; identical to SEQ ID NO: 237

SEQ ID NO: 239 - protein, 592 aa, Homo sapiens; identical to SEQ ID NO: 237

SEQ ID NO: 240 - protein, 160 aa, Homo sapiens
MQPASAKWYDRRDYVFIEFCVEDSKDVNVNFEKSKLTFSCLGGSDNFKHLNEIDLFHCIDPNDSKHKRTDRSILCCLRKGESGQSWPRLTKERAKLNWLSVDFNNWKDWEDDSDEDMSNFDRFSEMMNNMGGDEDVDLPEVDGADDDSQDSDDEKMPDLE

SEQ ID NO: 241 - protein, 160 aa, Homo sapiens; identical to SEQ ID NO: 240

SEQ ID NO: 242 - protein, 164 aa, Homo sapiens
MFYLRQPASAKWYDRRDYVFIEFCVEDSKDVNVNFEKSKLTFSCLGGSDNFKHLNEIDLFHCIDPNDSKHKRTDRSILCCLRKGESGQSWPRLTKERAKLNWLSVDFNNWKDWEDDSDEDMSNFDRFSEMMNNMGGDEDVDLPEVDGADDDSQDSDDEKMPDLE

SEQ ID NO: 243 - protein, 160 aa, Homo sapiens; identical to SEQ ID NO: 240

SEQ ID NO: 244 - protein, 160 aa, Homo sapiens; identical to SEQ ID NO: 240

SEQ ID NO: 245 - protein, 247 aa, Homo sapiens
MTALPAHRPPAHIQGNQKKETAQGRHRGSRCPCQRPSSHHSACFLGPEIMPLGLLWLGLALLGALHAQAQDSTSDLIPAPPLSKVPLQQNFQDNQFQGKWYVVGLAGNAILREDKDPQKMYATIYELKEDKSYNVTSVLFRKKKCDYWIRTFVPGCQPGEFTLGNIKSYPGLTSYLVRVVSTNYNQHAMVFFKKVSQNREYFKITLYGRTKELTSELKENFIRFSKSLGLPENHIVFPVPIDQCIDG

SEQ ID NO: 246 - protein, 198 aa, Homo sapiens
MPLGLLWLGLALLGALHAQAQDSTSDLIPAPPLSKVPLQQNFQDNQFQGKWYVVGLAGNAILREDKDPQKMYATIYELKEDKSYNVTSVLFRKKKCDYWIRTFVPGCQPGEFTLGNIKSYPGLTSYLVRVVSTNYNQHAMVFFKKVSQNREYFKITLYGRTKELTSELKENFIRFSKSLGLPENHIVFPVPIDQCIDG

SEQ ID NO: 247 - protein, 198 aa, Homo sapiens
MPLGLLWLGLALLGALHAQAQDSTSDLIPAPPLSKVPLQQNFQDNQFQGKWYVVGLAGNAILREDKDPQKMYATIYELKEDKSYNVTSVLFRKKKCDYWIRTFVPGCQPGEFTLGNIKSYPGLTSYLVRVVSTNYNQHAMVFFKKVSQNREYFKITLYGRTKELTSELKENFIRFSKSLGLPENHIVFPVPIGNGQSG

SEQ ID NO: 248 - protein, 198 aa, Homo sapiens
MPLGLLWLGLALLGALHAQAQDSTSDLIPAPPLSKVPLQQNFQDNQFQGKWYVVGLAGNAILREDKDPQKMYATIYELKEDKSYNVTSVLFRKKKCDYWIRTFVPGCQPGEFTLGNIKSYPGLTSYLVRVVSTNYNQHAMVFFKKVSQNREYFKITLYGRTKELTSELKENFIRFSKYLGLPENHIVFPVPIDQCIDG

SEQ ID NO: 249 - protein, 247 aa, Homo sapiens
MTALPAHRPPAHIQGNQKKETAQGRHRGSRCPCQRPSSHHSACFLGPEIMPLGLLWLGLALLGALHAQAQDSTSDLIPAPPLSKVPLQQNFQDNQFQGKWYVVGLAGNAILREDKDPQKMYATIYELKEDKSYNVTSVLFRKKKCDYWIRTFVPGCQPGEFTLGNIKSYPGLTSYLVRVVSTNYNQHAMVFFKKVSQNREYFKITLYGRTKELTSELKENFIRFSKSLGLPENHIVFPVPIGNGQSG

SEQ ID NO: 250 - protein, 198 aa, Homo sapiens; identical to SEQ ID NO: 246

SEQ ID NO: 251 - protein, 531 aa, Homo sapiens
MSKPHSEAGTAFIQTQQLHAAMADTFLEHMCRLDIDSPPITARNTGIICTIGPASRSVETLKEMIKSGMNVARLNFSHGTHEYHAETIKNVRTATESFASDPILYRPVAVALDTKGPEIRTGLIKGSGTAEVELKKGATLKITLDNAYMEKCDENILWLDYKNICKVVEVGSKIYVDDGLISLQVKQKGADFLVTEVENGGSLGSKKGVNLPGAAVDLPAVSEKDIQDLKFGVEQDVDMVFASFIRKASDVHEVRKVLGEKGKNIKIISKIENHEGVRRFDEILEASDGIMVARGDLGIEIPAEKVFLAQKMMIGRCNRAGKPVICATQMLESMIKKPRPTRAEGSDVANAVLDGADCIMLSGETAKGDYPLEAVRMQHLIAREAEAAMFHRKLFEELVRASSHSTDLMEAMAMGSVEASYKCLAAALIVLTESGRSAHQVARYRPRAPIIAVTRNPQTARQAHLYRGIFPVLCKDPVQEAWAEDVDLRVNFAMNVGKARGFFKKGDVVIVLTGWRPGSGFTNTMRVVPVP

SEQ ID NO: 252 - protein, 566 aa, Homo sapiens
MQWSSERGERLLTPGACSSEVPSAVPSRSGGTSAAMSKPHSEAGTAFIQTQQLHAAMADTFLEHMCRLDIDSPPITARNTGIICTIGPASRSVETLKEMIKSGMNVARLNFSHGTHEYHAETIKNVRTATESFASDPILYRPVAVALDTKGPEIRTGLIKGSGTAEVELKKGATLKITLDNAYMEKCDENILWLDYKNICKVVEVGSKIYVDDGLISLQVKQKGADFLVTEVENGGSLGSKKGVNLPGAAVDLPAVSEKDIQDLKFGVEQDVDMVFASFIRKASDVHEVRKVLGEKGKNIKIISKIENHEGVRRFDEILEASDGIMVARGDLGIEIPAEKVFLAQKMMIGRCNRAGKPVICATQMLESMIKKPRPTRAEGSDVANAVLDGADCIMLSGETAKGDYPLEAVRMQHLIAREAEAAMFHRKLFEELVRASSHSTDLMEAMAMGSVEASYKCLAAALIVLTESGRSAHQVARYRPRAPIIAVTRNPQTARQAHLYRGIFPVLCKDPVQEAWAEDVDLRVNFAMNVGKARGFFKKGDVVIVLTGWRPGSGFTNTMRVVPVP

SEQ ID NO: 253 - protein, 531 aa, Homo sapiens
MSKPHSEAGTAFIQTQQLHAAMADTFLEHMCRLDIDSPPITARNTGIICTIGPASRSVETLKEMIKSGMNVARLNFSHGTHEYHAETIKNVRTATESFASDPILYRPVAVALDTKGPEIRTGLIKGSGTAEVELKKGATLKITLDNAYMEKCDENILWLDYKNICKVVEVGSKIYVDDGLISLQVKQKGADFLVTEVENGGSLGSKKGVNLPGAAVDLPAVSEKDIQDLKFGVEQDVDMVFASFIRKASDVHEVRKVLGEKGKNIKIISKIENHEGVRRFDEILEASDGIMVARGDLGIEIPAEKVFLAQKMMIGRCNRAGKPVICATQMLESMIKKPRPTRAEGSDVANAVLDGADCIMLSGETAKGDYPLEAVRMQHLIAREAEAAIYHLQLFEELRRLAPITSDPTEATAVGAVEASFKCCSGAIIVLTKSGRSAHQVARYRPRAPIIAVTRNPQTARQAHLYRGIFPVLCKDPVQEAWAEDVDLRVNFAMNVGKARGFFKKGDVVIVLTGWRPGSGFTNTMRVVPVP

SEQ ID NO: 254 - protein, 552 aa, Homo sapiens
MTQPFNYSAFERIIFAGTSAAMSKPHSEAGTAFIQTQQLHAAMADTFLEHMCRLDIDSPPITARNTGIICTIGPASRSVETLKEMIKSGMNVARLNFSHGTHEYHAETIKNVRTATESFASDPILYRPVAVALDTKGPEIRTGLIKGSGTAEVELKKGATLKITLDNAYMEKCDENILWLDYKNICKVVEVGSKIYVDDGLISLQVKQKGADFLVTEVENGGSLGSKKGVNLPGAAVDLPAVSEKDIQDLKFGVEQDVDMVFASFIRKASDVHEVRKVLGEKGKNIKIISKIENHEGVRRFDEILEASDGIMVARGDLGIEIPAEKVFLAQKMMIGRCNRAGKPVICATQMLESMIKKPRPTRAEGSDVANAVLDGADCIMLSGETAKGDYPLEAVRMQHLIAREAEAAIYHLQLFEELRRLAPITSDPTEATAVGAVEASFKCCSGAIIVLTKSGRSAHQVARYRPRAPIIAVTRNPQTARQAHLYRGIFPVLCKDPVQEAWAEDVDLRVNFAMNVGKARGFFKKGDVVIVLTGWRPGSGFTNTMRVVPVP

SEQ ID NO: 255 - protein, 531 aa, Homo sapiens
MSKPHSEAGTAFIQTQQLHAAMADTFLEHMCRLDIDSPPITARNTGIICTIGPASRSVETLKEMIKSGMNVARLNFSHGTHEYHAETIKNVRTATESFASDPILYRPVAVALDTKGPEIRTGLIKGSGTAEVELKKGATLKITLDNAYMEKCDENILWLDYKNICKVVEVGSKIYVDDGLISLQVKQKGADFLVTEVENGGSLGSKKGVNLPGAAVDLPAVSEKDIQDLKFGVEQDVDMVFASFIRKASDVHEVRKVLGEKGKNIKIISKIENHEGVRRFDEILEASDGIMVARGDLGIEIPAEKVFLAQKMMIGRCNRAGKPVICATQMLESMIKKPRPTRAEGSDVANAVLDGADCIMLSGETAKGDYPLEAVRMQNLIAREAEAAIYHLQLFEELRRLAPITSDPTEATAVGAVEASFKCCSGAIIVLTKSGRSAHQVARYRPRAPIIAVTRNPQTARQAHLYRGIFPVLCKDPVQEAWAEDVDLRVNFAMNVGKARGFFKKGDVVIVLTGWRPGSGFTNTMRVVPVP

SEQ ID NO: 256 - protein, 531 aa, Homo sapiens; identical to SEQ ID NO: 251

SEQ ID NO: 257 - protein, 530 aa, Homo sapiens
SKPHSEAGTAFIQTQQLHAAMADTFLEHMCRLDIDSPPITARNTGIICTIGPASRSVETLKEMIKSGMNVARLNFSHGTHEYHAETIKNVRTATESFASDPILYRPVAVALDTKGPEIRTGLIKGSGTAEVELKKGATLKITLDNAYMEKCDENILWLDYKNICKVVEVGSKIYVDDGLISLQVKQKGADFLVTEVENGGSLGSKKGVNLPGAAVDLPAVSEKDIQDLKFGVEQDVDMVFASFIRKASDVHEVRKVLGEKGKNIKIISKIENHEGVRRFDEILEASDGIMVARGDLGIEIPAEKVFLAQKMMIGRCNRAGKPVICATQMLESMIKKPRPTRAEGSDVANAVLDGADCIMLSGETAKGDYPLEAVRMQNLIAREAEAAIYHLQLFEELRRLAPITSDPTEATAVGAVEASFKCCSGAIIVLTKSGRSAHQVARYRPRAPIIAVTRNPQTARQAHLYRGIFPVLCKDPVQEAWAEDVDLRVNFAMNVGKARGFFKKGDVVIVLTGWRPGSGFTNTMRVVPVP

SEQ ID NO: 258 - protein, 202 aa, Homo sapiens [sequence omitted]

SEQ ID NO: 259 - protein, 530 aa, Homo sapiens
SKPHSEAGTAFIQTQQLHAAMADTFLEHMCRLDIDSPPITARNTGIICTIGPASRSVETLKEMIKSGMNVARLNFSHGTHEYHAETIKNVRTATESFASDPILYRPVAVALDTKGPEIRTGLIKGSGTAEVELKKGATLKITLDNAYMEKCDENILWLDYKNICKVVEVGSKIYVDDGLISLQVKQKGADFLVTEVENGGSLGSKKGVNLPGAAVDLPAVSEKDIQDLKFGVEQDVDMVFASFIRKASDVHEVRKVLGEKGKNIKIISKIENHEGVRRFDEILEASDGIMVARGDLGIEIPAEKVFLAQKMMIGRCNRAGKPVICATQMLESMIKKPRPTRAEGSDVANAVLDGADCIMLSGETAKGDYPLEAVRMQHLIAREAEAAIYHLQLFEELRRLAPITSDPTEATAVGAVEASFKCCSGAIIVLTKSGRSAHQVARYRPRAPIIAVTRNPQTARQAHLYRGIFPVLCKDPVQEAWAEDVDLRVNFAMNVGKARGFFKKGDVVIVLTGWRPGSGFTNTMRVVPVP

SEQ ID NO: 260 - protein, 130 aa, Homo sapiens
MRQRPPSTTCNYLRNSHPLAPITSDPTKATAVGANEASFKCCSGAIIVLTKSGRSAHQVARYRPRAPIIAVTRNPQTASQAHLYRGIFPVLCKDPVQEARAEDVDRWVNLALNVGKARGFFKKGDMWSLC

SEQ ID NO: 261 - protein, 202 aa, Homo sapiens
MLESMIKKPRPTRAEGSDVANAVLDGADCIMLSGETAKGDYPLEAVRMQHLIAREAEAAMFHRKLFEELVRASSHSTDLMEAMAMGSVEASYKCLAAALIVLTESGRSAHQVARYRPRAPIIAVTRNPQTARQAHLYRGIFPVLCKDPVQEAWAEDVDLRVNFAMNVGKARGFFKKGDVVIVLTGWRPGSGFTNTMRVVPVP

SEQ ID NO: 262 - protein, 69 aa, Homo sapiens
AHLYRGIFPVLCKDPVQEAWAEDVDLRVNLAMNVGKAQAFFKKGDVVIVLTGWHPGSGFTNTMCVVPVP

SEQ ID NO: 263 - protein, 32 aa, Homo sapiens
MIVVTWHPQAARQAHLYRGIFPVLCKDPIQEP

SEQ ID NO: 264 - protein, 929 aa, Homo sapiens [sequence omitted]

SEQ ID NO: 265 - protein, 941 aa, Homo sapiens [sequence omitted]

SEQ ID NO: 266 - protein, 948 aa, Homo sapiens [sequence omitted]

SEQ ID NO: 267 - protein, 941 aa, Homo sapiens [sequence omitted]

SEQ ID NO: 268 - protein, 948 aa, Homo sapiens
MVFLPLKWSLAIMSFLLSSLLALLTVSTPSWCQSTEASPKRSDGTPFPWNKIRLPEYVIPVHYDLLIHANLTTLTFWGTTKVEITASQPTSTIILHSHHLQISRATLRKGAGERLSEEPLQVLEHPPQEQIALLAPEPLLVGLPYTVVIHYAGNLSETFHGFYKSTYRTKEGELRILASTQFEPTAARMAFPCFDEPAFKASFSIKIRREPRHLAISNMPLVKSVTVAEGLIEDHFDVTVKMSTYLVAFIISDFESVSKITKSGVKVSVYAVPDKINQADYALDAAVTLLEFYEDYFSIPYPLPKQDLAAIPDFQSGAMENWGLTTYRESALLFDAEKSSASSKLGITVTVAHELAHQWFGNLVTMEWWNDLWLNEGFAKFMEFVSVSVTHPELKVGDYFFGKCFDAMEVDALNSSHPVSTPVENPAQIREMFDDVSYDKGACILNMLREYLSADAFKSGIVQYLQKHSYKNTKNEDLWDSMASICPTDGVKGMDGFCSRSQHSSSSSHWHQEGVDVKTMMNTWTLQRGFPLITITVRGRNVHMKQEHYMKGSDGAPDTGYLWHVPLTFITSKSNMVHRFLLKTKTDVLILPEEVEWIKFNVGMNGYYIVHYEDDGWDSLTGLLKGTHTAVSSNDRASLINNAFQLVSIGKLSIEKALDLSLYLKHETEIMPVFQGLNELIPMYKLMEKRDMNEVETQFKAFLIRLLRDLIDKQTWTDEGSVSEQMLRSELLLLACVHNYQPCVQRAEGYFRKWKESNGNLSLPVDVTLAVFAVGAQSTEGWDFLYSKYQFSLSSTEKSQIEFALCRTQNKEKLQWLLDESFKGDKIKTQEFPQILTLIGRNPVGYPLAWQFLRKNWNKLVQKFELGSSSIAHMVMGTTNQFSTRTRLEEVKGFFSSLKENGSQLRCVQQTIETIEENIGWMDKNFDKIRVWLQSEKLEHDPEADATG

SEQ ID NO: 269 - protein, 371 aa, Homo sapiens
MAAAEAANCIMENFVATLANGMSLQPPLEEVSCGQAESSEKPNAEDMTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLYARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAKNNRDLDFTIDLDFKGQLCELSCSTDYRMR

SEQ ID NO: 270 - protein, 353 aa, Homo sapiens
MAAAEAANCIMEVSCGQAESSEKPNAEDMTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLYARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAKNNRDLDFTIDLDFKGQLCELSCSTDYRMR

SEQ ID NO: 271 - protein, 360 aa, Homo sapiens
MENFVATLANGMSLQPPLEEVSCGQAESSEKPNAEDMTSKDYYFDSYAHFGIHEEMLKDEVRTLTYRNSMFHNRHLFKDKVVLDVGSGTGILCMFAAKAGARKVIGIVCSSISDYAVKIVKANKLDHVVTIIKGKVEEVELPVEKVASSSASGWATASSTSPCSTPCSMPGTSVAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAKNNRDLDFTIDLDFKGQLCELSCSTDYRMR

SEQ ID NO: 272 - protein, 348 aa, Homo sapiens [sequence omitted]

SEQ ID NO: 273 - protein, 350 aa, Homo sapiens
MSLQPPLEEVSCGQAESSEKPNAEDMTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLYARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAKNNRDLDFTIDLDFKGQLCELSCSTDYRMR

SEQ ID NO: 274 - protein, 207 aa, Homo sapiens
LPLLRVHAQHCALCPDKWLAPNSLIFPERATLYVTATEDRQYKDYKIHWWENVYGFDISCIKDVAIKETLVDVVDLKQLVTNACLIKEVDIYTVKVEDLTFTSPFCLQVKQNDYVHTQVAYFNIEFTHCHKRTGGTGFSTIPESLYTHWKQTVFYMEDYLTLKTGEEIFGTIGMRPNAKNWDRDFTINLDFRGHLCDLSCSTDYRMC

SEQ ID NO: 275 - protein, 361 aa, Homo sapiens
MENFVATLANGMSLQPPLEEVSCGQAESSEKPNAEDMTSKDYYFDSYAHFGIHEEMLKDEVRTLTYRNSMFHNRHLFKDKVVLDVGSGTGILCMFAAKAGARKVIGIVCSSISDYAVKIVKANKLDHVVTIIKGKVEEVELPVEKVDIIISEWMGYCLFYESMLNTVLYARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAKNNRDLDFTIDLDFKGQLCELSCSTDYRMR

SEQ ID NO: 276 - protein, 292 aa, Homo sapiens
MLGAWAVEGTAVALLRLLLLLLPPAIRGPGLGVAGVAGAAGAGLPESVIWAVNAGGEAHVDVHGIHFRKDPLEGRVGRASDYGMKLPILRSNPEDQILYQTERYNEETFGYEVPIKEEGDYVLVLKFAEVYFAQSQQKVFDVRLNGHVVVKDLDIFDRVGHSTAHDEIIPMSIRKGKLSVQGEVSTFTGKLYIEFVKGYYDNPKVCALYIMAGTVDDVPKLQPHPGLEKKEEEEEEEEYDEGSNLKKQTNKNRVQSGPRTPNPYASDNSSLMFPILVAFGVFIPTLFCLCRL

SEQ ID NO: 277 - protein, 292 aa, Homo sapiens; identical to SEQ ID NO: 276

SEQ ID NO: 278 - protein, 363 aa, Homo sapiens
MLGAWAVEGTAVALLRLLLLLLPPAIRGPGLGVAGVAGAAGAGLPESVIWAVNAGGEAHVDVHGIHFRKDPLEGRVGRASDYGMKLPILRSNPEDQILYQTERYNEETFGYEVPIKEEGDYVLVLKFAEVYFAQSQQKVFDVRLNGHVVVKDLDIFDRVGHSTAHDEIIPMSIRKGKLSVQGEVSTFTGKLYIEFVKGYYDNPKVCALYIMAGTVDDVPKLQPHPGLEKKEEEEEEEEYDEGSNLKKQTNKNRVQSGPRTPNPYASDNSSLMFPILVAFGVFIPTLFCLCRLAGWVCFGLSPSVAPEEGETEARQSDSTLKQNRKHPGTVQKSQKKSASLRWKDIINDQRAFSLSVQTKTLCI

SEQ ID NO: 279 - protein, 724 aa, Homo sapiens
MPEEVHHGEEEVETFAFQAEIAQLMSLIINTFYSNKEIFLRELISNASDALDKIRYESLTDPSKLDSGKELKIDIIPNPQERTLTLVDTGIGMTKADLINNLGTIAKSGTKAFMEALQAGADISMIGQFGVGFYSAYLVAEKVVVITKHNDDEQYAWESSAGGSFTVRADHGEPIGRGTKVILHLKEDQTEYLEERRVKEVVKKHSQFIGYPITLYLEKEREKEISDDEAEEEKGEKEEEDKDDEEKPKIEDVGSDEEDDSGKDKKKKTKKIKEKYIDQEELNKTKPIWTRNPDDITQEEYGEFYKSLTNDWEDHLAVKHFSVEGQLEFRALLFIPRRAPFDLFENKKKKNNIKLYVRRVFIMDSCDELIPEYLNFIRGVVDSEDLPLNISREMLQQSKILKVIRKNIVKKCLELFSELAEDKENYKKFYEAFSKNLKLGIHEDSTNRRRLSELLRYHTSQSGDEMTSLSEYVSRMKETQKSIYYITGESKEQVANSAFVERVRKRGFEVVYMTEPIDEYCVQQLKEFDGKSLVSVTKEGLELPEDEEEKKKMEESKAKFENLCKLMKEILDKKVEKVTISNRLVSSPCCIVTSTYGWTANMERIMKAQALRDNSTMGYMMAKKHLEINPDHPIVETLRQKAEADKNDKAVKDLVVLLFETALLSSGFSLEDPQTHSNRIYRMIKLGLGIDEDEVAAEEPNAAVPDEIPPLEGDEDASRMEEVD

SEQ ID NO: 280 - protein, 56 aa, Homo sapiens [sequence omitted]

SEQ ID NO: 281 - protein, 724 aa, Homo sapiens; identical to SEQ ID NO: 279

SEQ ID NO: 282 - protein, 723 aa, Homo sapiens
PEEVHHGEEEVETFAFQAEIAQLMSLIINTFYSNKEIFLRELISNASDALDKIRYESLTDPSKLDSGKELKIDIIPNPQERTLTLVDTGIGMTKADLINNLGTIAKSGTKAFMEALQAGADISMIGQFGVGFYSAYLVAEKVVVITKHNDDEQYAWESSAGGSFTVRADHGEPIGRGTKVILHLKEDQTEYLEERRVKEVVKKHSQFIGYPITLYLEKEREKEISDDEAEEEKGEKEEEDKDDEEKPKIEDVGSDEEDDSGKDKKKKTKKIKEKYIDQEELNKTKPIWTRNPDDITQEEYGEFYKSLTNDWEDHLAVKHFSVEGQLEFRALLFIPRRAPFDLFENKKKKNNIKLYVRRVFIMDSCDELIPEYLNFIRGVVDSEDLPLNISREMLQQSKILKVIRKNIVKKCLELFSELAEDKENYKKFYEAFSKNLKLGIHEDSTNRRRLSELLRYHTSQSGDEMTSLSEYVSRMKETQKSIYYITGESKEQVANSAFVERVRKRGFEVVYMTEPIDEYCVQQLKEFDGKSLVSVTKEGLELPEDEEEKKKMEESKAKFENLCKLMKEILDKKVEKVTISNRLVSSPCCIVTSTYGWTANMERIMKAQALRDNSTMGYMMAKKHLEINPDHPIVETLRQKAEADKNDKAVKDLVVLLFETALLSSGFSLEDPQTHSNRIYRMIKLGLGIDEDEVAAEEPNAAVPDEIPPLEGDEDASRMEEVD

SEQ ID NO: 283 - protein, 20 aa, Homo sapiens
MEESKAKFENLCKLMKKNLR

SEQ ID NO: 284 - protein, 94 aa, Homo sapiens
MRTLAILAAILLVALQAQAEPLQARADEVAAAPEQIAADIPEVVVSLAWDESLAPKHPGSRKNMACYCRIPACIAGERRYGTCIYQGRLWAFCC

SEQ ID NO: 285 - protein, 94 aa, Homo sapiens
MRTLAILAAILLVALQAQAEPLQARADEVAAAPEQIAADIPEVVVSLAWDESLAPKHPGSRKNMDCYCRIPACIAGERRYGTCIYQGRLWAFCC

SEQ ID NO: 286 - protein, 1130 aa, Homo sapiens
MAAAGQLCLLYLSAGLLSRLGAAFNLDTREDNVIRKYGDPGSLFGFSLAMHWQLQPEDKRLLLVGAPRAEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGLLFLTSVSYTDPDQFVYKTRPPREQPDTFPDVMMNSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRSRYDDSVPRYHAVRIRKEEREIKDEKYIDNLEKKQWITKWNENESYS

SEQ ID NO: 287 - protein, 1073 aa, Homo sapiens
MAAAGQLCLLYLSAGLLSRLGAAFNLDTREDNVIRKYGDPGSLFGFSLAMHWQLQPEDKRLLLVGAPRAEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRNKKDHYDATYHKAEIHAQPSDKERLTSDA

SEQ ID NO: 288 - protein, 1091 aa, Homo sapiens
MAAAGQLCLLYLSAGLLSRLGAAFNLDTREDNVIRKYGDPGSLFGFSLAMHWQLQPEDKRLLLVGAPRAEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRSRYDDSVPRYHAVRIRKEEREIKDEKYIDNLEKKQWITKWNENESYS

SEQ ID NO: 289 - protein, 1130 aa, Homo sapiens
MAAAGQLCLLYLSAGLLSRLGAAFNLDTREDNVIRKYGDPGSLFGFSLAMHWQLQPEDKRLLLVGAPRGEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGLLFLTSVSYTDPDQFVYKTRPPREQPDTFPDVMMNSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRSRYDDSVPRYHAVRIRKEEREIKDEKYIDNLEKKQWITKWNRNESYS

SEQ ID NO: 290 - protein, 1073 aa, Homo sapiens
MAAAGQLCLLYLSAGLLSRLGAAFNLDTREDNVIRKYGDPGSLFGFSLAMHWQLQPEDKRLLLVGAPRGEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPYLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRNKKDHYDATYHKAEIHAQPSDKERLTSDA

SEQ ID NO: 291 - protein, 1805 aa, Homo sapiens
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTEHLVNGRMDFAFPGSTNSLHRMTTTSAAAYGTHLSPHVPHRVLSTSSTLTRDYNSLTRSEHSHSTTLPRDYSTLTSVSSHGLPPIWEHGRSRLPLSWALGSRSRAQMKGFPPSRGPRDSIILAGRPAAPSWGPDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGLTLGAQHLEAGGSLTRHVTQEFVSRTLTTSGTLSTHMDQQFFQT

SEQ ID NO: 292 - protein, 1702 aa, Homo sapiens
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTEHLVNGRMDFAFPGSTNSLHRMTTTSAAAYGTHLSPHVPHRVLSTSSTLTRDYNSLTRSEHSHSTTLPRDYSTLTSVSSHGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGLTLGAQHLEAGGSLTRHVTQEFVSRTLTTSGTLSTHMDQQFFQT

SEQ ID NO: 293 - protein, 1875 aa, Homo sapiens
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTGCGWKFEPLLGEELDLRRVTWRLPPELIPRLSASSGRSSDAEAPHGPPDDGGAGGKGGSLPRSATPGPPGEHLVNGRMDFAFPGSTNSLHRMTTTSAAAYGTHLSPHVPHRVLSTSSTLTRDYNSLTRSEHSHSTTLPRDYSTLTSVSSHGLPPIWEHGRSRLPLSWALGSRSRAQMKGFPPSRGPRDSIILAGRPAAPSWGPDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGLTLGAQHLEAGGSLTRHVTQEFVSRTLTTSGTLSTHMDQQFFQT

SEQ ID NO: 294 - protein, 1822 aa, Homo sapiens
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTGCGWKFEPLLGEELDLRRVTWRLPPELIPRLSASSGRSSDAEAPHGPPDDGGAGGKGGSLPRSATPGPPGEHLVNGRMDFAFPGSTNSLHRMTTTSAAAYGTHLSPHVPHRVLSTSSTLTRDYNSLTRSEHSHSTTLPRDYSTLTSVSSHDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGLTLGAQHLEAGGSLTRHVTQEFVSRTLTTSGTLSTHMDQQFFQT

SEQ ID NO: 295 - protein, 1822 aa, Homo sapiens
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTGCGWKFEPLLGEELDLRRVTWRLPPELIPRLSASSGRSSDAEAPTAPRTTAARAGRAAAVPRSATPGPPGEHLVNGRMDFAFPGSTNSLHRMTTTSAAAYGTHLSPHVPHRVLSTSSTLTRDYNSLTRSEHSHSTTLPRDYSTLTSVSSHDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGLTLGAQHLEAGGSLTRHVTQEFVSRTLTTSGTLSTHMDQQFFQT

SEQ ID NO: 296 - protein, 734 aa, Homo sapiens
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGIHPGLCEDLRSCVQCQAWGTGEKKGRTCEECNFKVKMVDELKRAEEVVVRCSFRDEDDDCTYSYTMEGDGAPGPNSTVLVHKKKGTTSPCLLLSRLPSGLLLVAHPPAPPPPAAPGPATAAMLEVLCLLQGLPGTSPVLQPRSHGGL

SEQ ID NO: 297 - protein, 964 aa, Homo sapiens
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENVRTQELGLAGDVAERGLQADLRCTQAPADQVPAAAQCREKARPHHCGHSADGAPLGQAGPAEAYREAGGTEGLPRPQGGPRLLHPHCRPGRPGHGGVPGGRGAGGRTGAPLYPA

SEQ ID NO: 298 - protein, 1752 aa, Homo sapiens
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTEHLVNGRMDFAFPGSTNSLHRMTTTSAAAYGTHLSPHVPHRVLSTSSTLTRDYNSLTRSEHSHSTTLPRDYSTLTSVSSHDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGLTLGAQHLEAGGSLTRHVTQEFVSRTLTTSGTLSTHMDQQFFQT

SEQ ID NO: 299 - protein, 1875 aa, Homo sapiens; identical to SEQ ID NO: 293

SEQ ID NO: 300 - protein, 1822 aa, Homo sapiens [sequence omitted]

SEQ ID NO: 301 - protein, 1752 aa, Homo sapiens; identical to SEQ ID NO: 298

SEQ ID NO: 302 - protein, 280 aa, Homo sapiens
MAAVVALSLRRRLPATTLGGACLQASRGAQTAAATAPRIKKFAIYRWDPDKAGDKPHMQTYEVDLNKCGPMVLDALIKIKNEVDSTLTFRRSCREGICGSCAMNINGGNTLACTRRIDTNLNKVSKIYPLPHMYVIKDLVPDLSNFYAQYKSIEPYLKKKDESQEGKQQYLQSIEEREKLDGLYECILCACCSTSCPSYWWNGDKYLGPAVLMQAYRWMIDSRDDFTEERLAKLQDPFSLYRCHTIMNCTRTCPKGLNPGKAIAEIKKMMATYKEKKASV

SEQ ID NO: 303 - protein, 223 aa, Homo sapiens
MQTYEVDLNKCGPMVLDALIKIKNEVDSTLTFRRSCREGICGSCAMNINGGNTLACTRRIDTNLNKVSKIYPLPHMYVIKDLVPDLSNFYAQYKSIEPYLKKKDESQEGKQQYLQSIEEREKLDGLYECILCACCSTSCPSYWWNGDKYLGPAVLMQAYRWMIDSRDDFTEERLAKLQDPFSLYRCHTIMNCTRTCPKGLNPGKAIAEIKKMMATYKEKKASV

SEQ ID NO: 304 - protein, 280 aa, Homo sapiens; identical to SEQ ID NO: 302

SEQ ID NO: 305 - protein, 440 aa, Homo sapiens
MALLVLGLVSCTFFLAVNGLYSSSDDVIELTPSNFNREVIQSDSLWLVEFYAPWCGHCQRLTPEWKKAATALKDVVKVGAVDADKHHSLGGQYGVQGFPTIKIFGSNKNRPEDYQGGRTGEAIVDAALSALRQLVKDRLGGRSGGYSSGKQGRSDSSSKKDVIELTDDSFDKNVLDSEDVWMVEFYAPWCGHCKNLEPEWAAAASEVKEQTKGKVKLAAVDATVNQVLASRYGIRGFPTIKIFQKGESPVDYDGGRTRSDIVSRALDLFSDNAPPPELLEIINEDIAKRTCEEHQLCVVAVLPHILDTGAAGRNSYLEVLLKLADKYKKKMWGWLWTEAGAQSELETALGIGGFGYPAMAAINARKMKFALLKGSFSEQGINEFLRELSFGRGSTAPVGGGAFPTIVEREPWDGRDGELPVEDDIDLSDVELDDLGKDEL

SEQ ID NO: 306 - protein, 259 aa, Homo sapiens
MVEFYAPWCGHCKNLEPEWAAAASEVKEQTKGKVKLAAVDATVNQVLASRYGIRGFPTIKIFQKGESPVDYDGGRTRSDIVSRALDLFSDNAPPPELLEIINEDIAKRTCEEHQLCVVAVLPHILDTGAAGRNSYLEVLLKLADKYKKKMWGWLWTEAGAQSELETALGIGGFGYPAMAAINARKMKFALLKGSFSEQGINEFLRELSFGRGSTAPVGGGAFPTIVEREPWDGRDGELPVEDDIDLSDVELDDLGKDEL

SEQ ID NO: 307 - protein, 440 aa, Homo sapiens; identical to SEQ ID NO: 305

SEQ ID NO: 308 - protein, 149 aa, Homo sapiens
METLYRVPFLVLECPNLKLKKPPWLHMPSAMTVYALVVVSYFLITGGIIYDVIVEPPSVGSMTDEHGHQRPVAFLAYRVNGQYIMEGLASSFLFTMGGLGFIILDRSNAPNIPKLNRFLLLFIGFVCVLLSFFMARVFMRMKLPGYLMG

SEQ ID NO: 309 - protein, 149 aa, Homo sapiens; identical to SEQ ID NO: 308

SEQ ID NO: 310 - protein, 149 aa, Homo sapiens; identical to SEQ ID NO: 308

SEQ ID NO: 311 - protein, 495 aa, Homo sapiens
MAGKVRSLLPPLLLAAAGLAGLLLLCVPTRDVREPPALKYGIVLDAGSSHTSMFIYKWPADKENDTGIVGQHSSCDVPGGGISSYADNPSGASQSLVGCLEQALQDVPKERHAGTPLYLGATAGMRLLNLTNPEASTSVLMAVTHTLTQYPFDFRGARILSGQEEGVFGWVTANYLLENFIKYGWVGRWFRPRKGTLGAMDLGGASTQITFETTSPAEDRASEVQLHLYGQHYRVYTHSFLCYGRDQVLQRLLASALQTHGFHPCWPRGFSTQVLLGDVYQSPCTMAQRPQNFNSSARVSLSGSSDPHLCRDLVSGLFSFSSCPFSRCSFNGVFQPPVAGNFVAFSAFFYTVDFLRTSMGLPVATLQQLEAAAVNVCNQTWAQLQARVPGQRARLADYCAGAMFVQQLLSRGYGFDERAFGGVIFQKKAADTAVGWALGYMLNLTNLIPADPPGLRKGTDFSSWVVLLLLFASALLAALVLLLRQVHSAKLPSTI

SEQ ID NO: 312 - protein, 495 aa, Homo sapiens; identical to SEQ ID NO: 311

SEQ ID NO: 313 - protein, 472 aa, Homo sapiens
MAGKVRSLLPPLLLAAAGLAGLLLLCVPTRDVREPPALKYGIVLDAGSSHTSMFIYKWPADKENDTGIVGQHSSCDVPGGGISSYADNPSGASQSLVGCLEQALQDVPKERHAGTPLYLGATAGMRLLNLTNPEASTSVLMAVTHTLTQYPFDFRGARILSGQEEGVFGWVTANYLLENFIKYGWVGRWFRPRKGTLGAMDLGGASTQITFETTSPAEDRASEVQLHLYGQHYRVYTHSFLCYGRDQVLQRLLASALQTHGFHPCWPRGFSTQVLLGDVYQSPCTMAQRPQNFNSSARVSLSGSSDPHLCRDLVSGLFSFSSCPFSRCSFNGVFQPPVAGNFVAFSAFFYTVDFLRTSMGLPVATLQQLEAAAVNVCNQTWAQQLLSRGYGFDERAFGGVIFQKKAADTAVGWALGYMLNLTNLIPADPPGLRKGTDFSSWVVLLLLFASALLAALVLLLRQVHSAKLPSTI

SEQ ID NO: 314 - protein, 242 aa, Homo sapiens
MAETEALSKLREDFRMQNKSVFILGASGETGRVLLKEILEQGLFSKVTLIGRRKLTFDEEAYKNVNQEVVDFEKLDDYASAFQGHDVGFCCLGTTRGKAGAEGFVRVDRDYVLKSAELAKAGGCKHFNLLSSKGADKSSNFLYLQVKGEVEAKVEELKFDRYSVFRPGVLLCDRQESRPGEWLVRKFFGSLPDSWARGHSVPVVTVVRAMLNNVVRPRDKQMELLENKAIHDLGKAHGSLKP

SEQ ID NO: 315 - protein, 242 aa, Homo sapiens; identical to SEQ ID NO: 314

SEQ ID NO: 316 - protein, 276 aa, Homo sapiens [sequence omitted]

SEQ ID NO: 317 - protein, 242 aa, Homo sapiens; identical to SEQ ID NO: 314

SEQ ID NO: 318 - protein, 298 aa, Homo sapiens
MGDHAWSFLKDFLAGGVAAAVSKTAVAPIERVKLLLQVQHASKQISAEKQYKGIIDCVVRIPKEQGFLSFWRGNLANVIRYFPTQALNFAFKDKYKQLFLGGVDRHKQFWRYFAGNLASGGAAGATSLCFVYPLDFARTRLAADVGKGAAQREFHGLGDCIIKIFKSDGLRGLYQGFNVSVQGIIIYRAAYFGVYDTAKGMLPDPKNVHIFVSWMIAQSVTAVAGLVSYPFDTVRRRMMMQSGRKGADIMYTGTVDCWRKIAKDEGAKAFFKGAWSNVLRGMGGAFVLVLYDEIKKYV

SEQ ID NO: 319 - protein, 298 aa, Homo sapiens; identical to SEQ ID NO: 318

SEQ ID NO: 320 - protein, 297 aa, Homo sapiens
MGDHAWSFLKDFLAGAVAAAVSKTAVAPIERVKLLLQVQHASKQISAEKQYKGIIDCVVRIPKEQGFLSFWRGNLANVIRYFPTQALNFAFKDKYKQLFLGGVDRHKQFWRYFAGNLASGGAAGATSLCFVYPLDFARTRLAADVGRRAQREFHGLGDCIIKIFKSDGLRGLYQGFNVSVQGIIIYRAAYFGVYDTAKGMLPDPKNVHIFVSWMIAQSVTAVAGLLSYPFDTVRRRMMMQSGRKGADIMYTGTVDCWRKIAKDEGAKAFFKGAWSNVLRGMGGAFVLVLYDEIKKYV

SEQ ID NO: 321 - protein, 298 aa, Homo sapiens; identical to SEQ ID NO: 318

SEQ ID NO: 322 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 323 - protein, 541 aa, Homo sapiens [sequence omitted]

SEQ ID NO: 324 - protein, 326 aa, Homo sapiens
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 325 - protein, 290 aa, Homo sapiens
QMQGVNCTVSSELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVQVHNAKTKPREQQFNSTFRVVSVLTVLHQNWLDGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 326 - protein, 376 aa, Homo sapiens [sequence omitted]

SEQ ID NO: 327 - protein, 196 aa, Homo sapiens [sequence omitted]

SEQ ID NO: 328 - protein, 360 aa, Homo sapiens
MARAEAKLEALDCADSRQAQSADLAAEPRLLGCRASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPGK

SEQ ID NO: 329 - protein, 330 aa, Homo sapiens [sequence omitted]

SEQ ID NO: 330 - protein, 398 aa, Homo sapiens [sequence omitted]

SEQ ID NO: 331 - protein, 217 aa, Homo sapiens [sequence omitted]

SEQ ID NO: 332 - protein, 215 aa, Homo sapiens [sequence omitted]

SEQ ID NO: 333 - protein, 212 aa, Homo sapiens
VFRRFVEVGRVAYVSFGPHAGKLVAIVDVIDQNRALVDGPCTQVRRQAMPFKCMQLTDFILKFPHSAHQKYVRQAWQKADINTKWAATRWAKKIEARERKAKMTDFDRFKVMKAKKMRNRIIKNEVKKLQKAALLKASPKKAPGTKGTAAAAAAAAKVPAKKITAASKKAPAQKVPAQKATGQKAAPAPKAQKGQKAPAQKAPAPKASGKKA

SEQ ID NO: 334 - protein, 213 aa, Homo sapiens [sequence omitted]

SEQ ID NO: 335 - protein, 168 aa, Homo sapiens [sequence omitted]

SEQ ID NO: 336 - protein, 145 aa, Homo sapiens
MMFKHFLEVCQVAYVSFGPYAGKLVAVVDVTDENRALADGLCTQVMGQAVSFKCMQLTDFILKFPHSTHQRKLRKAALLKASTRKAPAAKVPAKKMITAGKKAPARKIPAQKATGQKAALLQKAQKGQKVLAQGAPSPKVSGKEA

SEQ ID NO: 337 - protein, 339 aa, Homo sapiens
MWQLWASLCCLLVLANARSRPSFHPLSDELVNYVNKRNTTWQAGHNFYNVDMSYLKRLCGTFLGGPKPPQRVMFTEDLKLPASFDAREQWPQCPTIKEIRDQGSCGSCWAFGAVEAISDRICIHTNAHVSVEVSAEDLLTCCGSMCGDGCNGGYPAEAWNFWTRKGLVSGGLYESHVGCRPYSIPPCEHHVNGSRPPCTGEGDTPKCSKICEPGYSPTYKQDKHYGYNSYSVSNSEKDIMAEIYKNGPVEGAFSVYSDFLLYKSGVYQHVTGEMMGGHAIRILGWGVENGTPYWLVANSWNTDWGDNGFFKILRGQDHCGIESEVVAGIPRTDQYWEKI

SEQ ID NO: 338 - protein, 339 aa, Homo sapiens; identical to SEQ ID NO: 337

SEQ ID NO: 339 - protein, 339 aa, Homo sapiens; identical to SEQ ID NO: 337

SEQ ID NO: 340 - protein, 339 aa, Homo sapiens [sequence omitted]

SEQ ID NO: 341 - protein, 339 aa, Homo sapiens; identical to SEQ ID NO: 337

SEQ ID NO: 342 - protein, 339 aa, Homo sapiens; identical to SEQ ID NO: 337

SEQ ID NO: 343 - protein, 339 aa, Homo sapiens; identical to SEQ ID NO: 337

SEQ ID NO: 344 - protein, 339 aa, Homo sapiens; identical to SEQ ID NO: 337

SEQ ID NO: 345 - protein, 339 aa, Homo sapiens; identical to SEQ ID NO: 337

SEQ ID NO: 346 - protein, 72 aa, Homo sapiens
QVPARAGAPGAGPAQVKARLGRRPRLRCTQLPAITSSRPGPRGQVLLYTRRKYSLSNSKLPFITEQAPGSKP

SEQ ID NO: 347 - protein, 72 aa, Homo sapiens; identical to SEQ ID NO: 346

SEQ ID NO: 348 - protein, 72 aa, Homo sapiens; identical to SEQ ID NO: 346

SEQ ID NO: 349 - protein, 72 aa, Homo sapiens; identical to SEQ ID NO: 346

SEQ ID NO: 350 - protein, 72 aa, Homo sapiens; identical to SEQ ID NO: 346

SEQ ID NO: 351 - protein, 1214 aa, Homo sapiens
MAVRKKDGGPNVKYYEAADTVTQFDNVRLWLGKNYKKYIQAEPPTNKSLSSLVVQLLQFQEEVFGKHVSNAPLTKLPIKCFLDFKAGGSLCHILAAAYKFKSDQGWRRYDFQNPSRMDRNVEMFMTIEKSLVQNNCLSRPNIFLCPEIEPKLLGKLKDIIKRHQGTVTEDKNNASHVVYPVPGNLEEEEWVRPVMKRDKQVLLHWGYYPDSYDTWIPASEIEASVEDAPTPEKPRKVHAKWILDTDTFNEWMNEEDYEVNDDKNPVSRRKKISAKTLTDEVNSPDSDRRDKKGGNYKKRKRSPSPSPTPEAKKKNAKKGPSTPYTKSKRGHREEEQEDLTKDMDEPSPVPNVEEVTLPKTVNTKKDSESAPVKGGTMTDLDEQEDESMETTGKDEDENSTGNKGEQTKNPDLHEDNVTEQTHHIIIPSYAAWFDYNSVHAIERRALPEFFNGKNKSKTPEIYLAYRNFMIDTYRLNPQEYLTSTACRRNLAGDVCAIMRVHAFLEQWGLINYQVDAESRPTPMGPPPTSHFHVLADTPSGLVPLQPKTPQQTSASQQMLNFPDKGKEKPTDMQNFGLRTDMYTKKNVPSKSKAAASATREWTEQETLLLLEALEMYKDDWNKVSEHVGSRTQDECILHFLRLPIEDPYLEDSEASLGPLAYQPIPFSQSGNPVMSTVAFLASVVDPRVASAAAKSALEEFSKMKEEVPTALVEAHVRKVEEAAKVTGKADPAFGLESSGIAGTTSDEPERIEESGNDEARVEGQATDEKKEPKEPREGGGAIEEEAKEKTSEAPKKDEEKGKEGDSEKESEKSDGDPIVDPEKEKEPKEGQEEVLKEVVESEGERKTKVERDIGEGNLSTAAAAALAAAAVKAKHLAAVEERKIKSLVALLVETQMKKLEIKLRHFEELETIMDREREALEYQRQQLLADRQAFHMEQLKYAEMRARQQHFQQMHQQQQQPPPALPPGSQPIPPTGAAGPPAVHGLAVAPASVVPAPAGSGAPPGSLGPSEQIGQAGSTAGPQQQQPAGAPQPGAVPPGVPPPGPHGPSPFPNQQTPPSMMPGAVPGSGHPGVAGNAPLGLPFGMPPPPPPPAPSIIPFGSLADSISINLPAPPNLHGHHHHLPFAPGTLPPPNLPVSMANPLHPNLPATTTMPSSLPLGPGLGSAAAQSPAIVAAVQGNLLPSASPLPDPGTPLPPDPTAPSPGTVTPVPPPQ

SEQ ID NO: 352 - protein, 1105 aa, Homo sapiens
MAAAAGGGGPGTAVGATGSGIAAAAAGLAVYRRKDGGPATKFWESPETVSQLDSVRVWLGKHYKKYVHADAPTNKTLAGLVVQLLQFQEDAFGKHVTNPAFTKLPAKCFMDFKAGGALCHILGAAYKYKNEQGWRRFDLQNPSRMDRNVEMFMNIEKTLVQNNCLTRPNIYLIPDIDLKLANKLKDIIKRHQGTFTDEKSKASHHIYPYSSSQDDEEWLRPVMRKEKQVLVHWGFYPDSYDTWVHSNDVDAEIEDPPIPEKPWKVHVKWILDTDIFNEWMNEEDYEVDENRKPVSFRQRISTKNEEPVRSPERRDRKASANARKRKHSPSPPPPTPTESRKKSGKKGQASLYGKRRSQKEEDEQEDLTKDMEDPTPVPNIEEVVLPKNVNLKKDSENTPVKGGTVADLDEQDEETVTAGGKEDEDPAKGDQSRSVDLGEDNVTEQTNHIIIPSYASWFDYNCIHVIERRALPEFFNGKNKSKTPEIYLAYRNFMIDTYRLNPQEYLTSTACRRNLTGDVCAVMRVHAGGEQWGLVNYQVDPESRPMAMGPPPTPHFNVLADTPSGLVPLHLRSPQVPAAQQMLNFPEKNKEKPVDLQNFGLRTDIYSKKTLAKSKGASAGREWTEQETLLLLEALEMYKDDWNKVSEHVGSRTQDECILHFLRLPIEDPYLENSDASLGPLAYQPVPFSQSGNPVMSTVAFLASVVDPRVASAAAKAALEEFSRVREEVPLELVEAHVKKVQEAARASGKVDPTYGLESSCIAGTGPDEPEKLEGAEEEKMEADPDGQQPEKAENKVENETDEGDKAQDGENEKNSEKEQDSEVSEDTKSEEKETEENKELTDTCKERESDTGKKKVEHEISEGNVATAAAAALASAATKAKHLAAVEERKIKSLVALLVETQMKKLEIKLRHFEELETIMDREKEALEQQRQQLLTERQNFHMEQLKYAELRARQQMEQQQHGQNPQQAHQHSGGPGLAPLGAAGHPGMMPHQQPPPYPLMHHQMPPPHPPQPGQIPGPGSMMPGQHMPGRMIPTVAANIHPSGSGPTPPGMPPMPGNILGPRVPLTAPNGMYPPPPQQQPPPPPPADGVPPPPAPGPPASAAP

SEQ ID NO: 353 - protein, 883 aa, Homo sapiens
MRKEKQVLVHWGFYPDSYDTWVHSNDVDAEIEDPPIPEKPWKVHVKWILDTDIFNEWMNEEDYEVDENRKPVSFRQRISTKNEEPVRSPERRDRKASANARKRKHSPSPPPPTPTESRKKSGKKGQASLYGKRRSQKEEDEQEDLTKDMEDPTPVPNIEEVVLPKNVNLKKDSENTPVKGGTVADLDEQDEETVTAGGKEDEDPAKGDQSRSVDLGEDNVTEQTNHIIIPSYASWFDYNCIHVIERRALPEFFNGKNKSKTPEIYLAYRNFMIDTYRLNPQEYLTSTACRRNLTGDVCAVMRVHAFLEQWGLVNYQVDPESRPMAMGPPPTPHFNVLADTPSGLVPLHLRSPQVPAAQQMLNFPEKNKEKPVDLQNFGLRTDIYSKKTLAKSKGASAGREWTEQETLLLLEALEMYKDDWNKVSEHVGSRTQDECILHFLRLPIEDPYLENSDASLGPLAYQPVPFSQSGNPVMSTVAFLASVVDPRVASAAAKAALEEFSRVREEVPLELVEAHVKKVQEAARASGKVDPTYGLESSCIAGTGPDEPEKLEGAEEEKMEADPDGQQPEKAENKVENETDEGDKAQDGENEKNSEKEQDSEVSEDTKSEEKETEENKELTDTCKERESDTGKKKVEHEISEGNVATAAAAALASAATKAKHLAAVEERKIKSLVALLVETQMKKLEIKLRHFEELETIMDREKEALEQQRQQLLTERQNFHMEQLKYAELRARQQMEQQQHGQNPQQAHQHSGGPGLAPLGAAGHPGMMPHQQPPPYPLMHHQMPPPHPPQPGQIPGPGSMMPGQHMPGRMIPTVAANIHPSGSGPTPPGMPPMPGNILGPRVPLTAPNGMYPPPPQQQPPPPPPADGVPPPPAPGPPASAAP

SEQ ID NO: 354 - protein, 767 aa, Homo sapiens [sequence omitted]

SEQ ID NO: 355 - protein, 1214 aa, Homo sapiens; identical to SEQ ID NO: 351

SEQ ID NO: 356 - protein, 1130 aa, Homo sapiens
MAVRKKDGGPNVKYYEAADTVTQFDNVRLWLGKNYKKYIQAEPPTNKSLSSLVVQLLQFQEEVFGKHVSNAPLTKLPIKCFLDFKAGGSLCHILAAAYKFKSDQGWRRYDFQNPSRMDRNVEMFMTIEKSLVQNNCLSRPNIFLCPEIEPKLLGKLKDIIKRHQGTVTEDKNNASHVVYPVPGNLEEEEWVRPVMKRDKQVLLHWGYYPDSYDTWIPASEIEASVEDAPTPEKPRKVHAKWILDTDTFNEWMNEEDYEVNDDKNPVSRRKKISAKTLTDEVNSPDSDRRDKKGGNYKKRKRSPSPSPTPEAKKKNAKKGPSTPYTKSKRGHREEEQEDLTKDMDEPSPVPNVEEVTLPKTVNTKKDSESAPVKGGTMTDLDEQEDESMETTGKDEDENSTGNKGEQTKNPDLHEDNVTEQTHHIIIPSYAAWFDYNSVHAIERRALPEFFNGKNKSKTPEIYLAYRNFMIDTYRLNPQEYLTSTACRRNLAGDVCAIMRVHAFLEQWGLINYQVDAESRPTPMGPPPTSHFHVLADTPSGLVPLQPKTPQGRQVDADTKAGRKGKELDDLVPETAKGKPELQTSASQQMLNFPDKGKEKPTDMQNFGLRTDMYTKKNVPSKSKAAASATREWTEQETLLLLEALEMYKDDWNKVSEHVGSRTQDECILHFLRLPIEDPYLEDSEASLGPLAYQPIPFSQSGNPVMSTVAFLASVVDPRVASAAAKSALEEFSKMKEEVPTALVEAHVRKVEEAAKVTGKADPAFGLESSGIAGTTSDEPERIEESGNDEARVEGQATDEKKEPKEPREGGGAIEEEAKEKTSEAPKKDEEKGKEGDSEKESEKSDGDPIVDPEKEKEPKEGQEEVLKEVVESEGERKTKVERDIGEGNLSTAAAAALAAAAVKAKHLAAVEERKIKSLVALLVETQMKKLEIKLRHFEELETIMDREREALEYQRQQLLADRQAFHMEQLKYAEMRARQQHFQQMHQQQQQPPPALPPGSQPIPPTGAAGPPAVHGLAVAPASVVPAPAGSGAPPGSLGPSEQIGQAGSTAGPQQQQPAGAPQPGAVPPGVPPPGPHGPSPFPNQQTPPSMMPGAVPGSGHPGVADPGTPLPPDPTAPSPGTVTPVPPPQ

SEQ ID NO: 357 - protein, 1130 aa, Homo sapiens; identical to SEQ ID NO: 356

SEQ ID NO: 358 - protein, 288 aa, Homo sapiens [sequence omitted]

SEQ ID NO: 359 - protein, 287 aa, Homo sapiens
AEKRHTRDSEAQRLPDSFKDSPSKGLGPCGWILVAFSFLFTVITFPISIWMCIKIIKEYERAIIFRLGRILQGGAKGPGLFFILPCTDSFIKVDMRTISFDIPPQEILTKDSVTISVDGVVYYRVQNATLAVANITNADSATRLLAQTTLRNVLGTKNLSQILSDREEIAHNMQSTLDDATDAWGIKVERVEIKDVKLPVQLQRAMAAEAEASREARAKVIAAEGEMNASRALKEASMVITESPAALQLRYLQTLTTIAAEKNSTIVFPLPIDMLQGIIGAKHSHLG

SEQ ID NO: 360 - protein, 288 aa, Homo sapiens [sequence omitted]

SEQ ID NO: 361 - protein, 286 aa, Homo sapiens
MAEKRHTRDSEAQRLPDSDSPSKGLGPCGWILVAFSFLFTVITFPISIWMCIKIIKEYERAIIFRLGRILQGGAKGPGLFFILPCTDSFIKVDMRTISFDIPPQEILTKDSVTISVDGVVYYRVQNATLAVANITNADSATRLLAQTTLRNVLGTKNLSQILSDREEIAHNMQSTLDDATDAWGIKVERVEIKDVKLPVQLQRAMAAEAEASREARAKVIAAEGEMNASRALKEASMVITESPAALQLRYLQTLTTIAAEKNSTIVFPLPIDMLQGIIGAKHSHLG

SEQ ID NO: 362 - protein, 237 aa, Homo sapiens
MCIKIIKEYERAIIFRLGRILQGGAKGPGLFFILPCTDSFIKVDMRTISFDIPPQEILTKDSVTISVDGVVYYRVQNATLAVANITNADSATRLLAQTTLRNVLGTKNLSQILSDREEIAHNMQSTLDDATDAWGIKVERVEIKDVKLPVQLQRAMAAEAEASREARAKVIAAEGEMNASRALKEASMVITESPAALQLRYLQTLTTIAAEKNSTIVFPLPIDMLQGIIGAKHSHLG

SEQ ID NO: 363 - protein, 505 aa, Homo sapiens
MRLRRLALFPGVALLLAAARLAAASDVLELTDDNFESRISDTGSAGLMLVEFFAPWCGHCKRLAPEYEAAATRLKGIVPLAKVDCTANTNTCNKYGVSGYPTLKIFRDGEEAGAYDGPRTADGIVSHLKKQAGPASVPLRTEEEFKKFISDKDASIVGFFDDSFSEAHSEFLKAASNLRDNYRFAHTNVESLVNEYDDNGEGIILFRPSHLTNKFEDKTVAYTEQKMTSGKIKKFIQENIFGICPHMTEDNKDLIQGKDLLIAYYDVDYEKNAKGSNYWRNRVMMVAKKFLDAGHKLNFAVASRKTFSHELSDFGLESTAGEIPVVAIRTAKGEKFVMQEEFSRDGKALERFLQDYFDGNLKRYLKSEPIPESNDGPVKVVVAENFDEIVNNENKDVLIEFYAPWCGHCKNLEPKYKELGEKLSKDPNIVIAKMDATANDVPSPYEVRGFPTIYFSPANKKLNPKKYEGGRELSDFISYLQREATNPPVIQEEKPKKKKKAQEDL

SEQ ID NO: 364 - protein, 461 aa, Homo sapiens
MCLRRPALFPGVALLLAAARLAAASDVLGLRDDNLESRISDTGSAGLMLVEFFAPWCGHCKRLAPEYEAAATRLKGIVPLAKADCTANTNTCNKYGVSGYPTLNMFRDGEEAGAYDGPRTADGIVSHLKKQAGPASVPLRTEEEFKKFISDKDASIVGFFDDSFSEAHSEFLKAASNLRDNYRFAHTNVESLVNEYDDNGDGIILFRPSHLTNKLEDKTVAYTVQKMTSGKIKKFIQENIFGICPHMTEDNKDLIQGKDLLIAYYDVDYEKNAKGSNYWRNRVMMVAKKFLDAGHKLNFAVASRKTFSHELSDFGLESTAGEIPVVAIRTAKGEKFVMQEDFSRDGNALERFLQDYFDGNLKRYLKSEPIPESNDGPVKVVVAENFDEIVNNENKDVLIEFYAPWCGHCKNLEPKYKELGEKLSKDLNIVIAKMDATANDVPSPYEVRVFLPYTSLQPTRS

SEQ ID NO: 365 - protein, 505 aa, Homo sapiens; identical to SEQ ID NO: 363

SEQ ID NO: 366 - protein, 50 aa, Homo sapiens
WPEPGPLPDLQPPERSQPPPARGGLGGPRTGGSCEGAISWPKSWAAVVKI

SEQ ID NO: 367 - protein, 777 aa, Homo sapiens
MGVPFFSSLRCMVDLGPCWAGGLTAEMKLLLALAGLLAILATPQPSEGAAPAVLGEVDTSLVLSSMEEAKQLVDKAYKERRESIKQRLRSGSASPMELLSYFKQPVAATRTAVRAADYLHVALDLLERKLRSLWRRPFNVTDVLTPAQLNVLSKSSGCAYQDVGVTCPEQDKYRTITGMCNNRCGWLGVAAGTGLREASRTPQASRCQRPVLPCRRSPTLGASNRAFVRWLPAEYEDGFSLPYGWTPGVKRNGFPVALARAVSNEIVRFPTDQLTPDQERSLMFMQWGQLLDHDLDFTPEPAARASFVTGVNCETSCVQQPPCFPLKIPPNDPRIKNQADCIPFFRSCPACPGSNITIRNQINALTSFVDASMVYGSEEPLARNLRNMSNQLGLLAVNQRFQDNGRALLPFDNLHDDPCLLTNRSARIPCFLAGDTRSSEMPELTSMHTLLLREHNRLATELKSLNPRWDGERLYQEARKIVGAMVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDRFWWENEGVFSMQQRQALAQISLPRIICDNTGITTVSKNNIFMSNSYPRDFVNCSTLPALNLASWREAS

SEQ ID NO: 368 - protein, 75 aa, Homo sapiens
MVIGEEGFWWENEGVFSMQQRQALAQISLPRIICDNTGITTVSKNNIFMSNSYPRDFVNCSTLPALNLASWREAS

SEQ ID NO: 369 - protein, 792 aa, Homo sapiens
MGVPFFSSLRCMVDLGPCWAGGLTAEMKLLLALAGLLAILATPQPSEGAAPAVLGEVDTSLVLSSMEEAKQLVDKAYKERRERWGTRHCPALGKDVPGLSEKQQAAGSLKVGEGDYGDPCGLPFCLSVPVIKQRLRSGSASPMELLSYFKQPVAATRTAVRAADYLHVALDLLERKLRSLWRRPFNVTDVLTPAQLNVLSKSSGCAYQDVGVTCPEQDKYRTITGMCNNRRSPTLGASNRAFVRWLPAEYEDGFSLPYGWTPGVKRNGFPVALARAVSNEIVRFPTDQLTPDQERSLMFMQWGQLLDHDLDFTPEPAARASFVTGVNCETSCVQQPPCFPLKIPPNDPRIKNQADCIPFFRSCPACPGSNITIRNQINALTSFVDASMVYGSEEPLARNLRNMSNQLGLLAVNQRFQDNGRALLPFDNLHDDPCLLTNRSARIPCFLAGDTRSSEMPELTSMHTLLLREHNRLATELKSLNPRWDGERLYQEARKIVGAMVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDRFWWENEGVFSMQQRQALAQISLPRIICDNTGITTVSKNNIFMSNSYPRDFVNCSTLPALNLASWREAS

SEQ ID NO: 370 - protein, 745 aa, Homo sapiens
MGVPFFSSLRCMVDLGPCWAGGLTAEMKLLLALAGLLAILATPQPSEGAAPAVLGEVDTSLVLSSMEEAKQLVDKAYKERRESIKQRLRSGSASPMELLSYFKQPVAATRTAVRAADYLHVALDLLERKLRSLWRRPFNVTDVLTPAQLNVLSKSSGCAYQDVGVTCPEQDKYRTITGMCNNRRSPTLGASNRAFVRWLPAEYEDGFSLPYGWTPGVKRNGFPVALARAVSNEIVRFPTDQLTPDQERSLMFMQWGQLLDHDLDFTPEPAARASFVTGVNCETSCVQQPPCFPLKIPPNDPRIKNQADCIPFFRSCPACPGSNITIRNQINALTSFVDASMVYGSEEPLARNLRNMSNQLGLLAVNQRFQDNGRALLPFDNLHDDPCLLTNRSARIPCFLAGDTRSSEMPELTSMHTLLLREHNRLATELKSLNPRWDGERLYQEARKIVGAMVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDRFWWENEGVFSMQQRQALAQISLPRIICDNTGITTVSKNNIFMSNSYPRDFVNCSTLPALNLASWREAS

SEQ ID NO: 371 - protein, 745 aa, Homo sapiens; identical to SEQ ID NO: 370

SEQ ID NO: 372 - protein, 102 aa, Homo sapiens [sequence omitted]

SEQ ID NO: 373 - protein, 303 aa, Homo sapiens
MARGKAKEEGSWKKFIWNSEKKEFLGRTGGSWFKILLFYVIFYGCLAGIFIGTIQVMLLTISEFKPTYQDRVAPPGLTQIPQIQKTEISFRPNDPKSYEAYVLNIVRFLEKYKDSAQRDDMIFEDCGDVPSEPKERGDFNHERGERKVCRFKLEWLGNCSGLNDETYGYKEGKPCIIIKLNRVLGFKPKPPKNESLETYPVMKYNPNVLPVQCTGKRDEDKDKVGNVEYFGLGNSPGFPLQYYPYYGKLLQPKYLQPLLAVQFTNLTMDTEIRIECKAYGENIGYSEKDRFQGRFDVKIEVKS

SEQ ID NO: 374 - protein, 303 aa, Homo sapiens; identical to SEQ ID NO: 373

SEQ ID NO: 375 - protein, 731 aa, Homo sapiens
MVVEHPEFLKAGKEPGLQIWRVEKFDLVPVPTNLYGDFFTGDAYVILKTVQLRNGNLQYDLHYWLGNECSQDESGAAAIFTVQLDDYLNGRAVQHREVQGFESATFLGYFKSGLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPEAMLQVLGPKPALPAGTEDTAKEDAANRKLAKLYKVSNGAGTMSVSLVADENPFAQGALKSEDCFILDHGKDGKIFVWKGKQANTEERKAALKTASDFITKMDYPKQTQVSVLPEGGETPLFKQFFKNWRDPDQTDGLGLSYLSSHIANVERVPFDAATLHTSTAMAAQHGMDDDGTGQKQIWRIEGSNKVPVDPATYGQFYGGDSYIILYNYRHGGRQGQIIYNWQGAQSTQDEVAASAILTAQLDEELGGTPVQSRVVQGKEPAHLMSLFGGKPMIIYKGGTSREGGQTAPASTRLFQVRANSAGATRAVEVLPKAGALNSNDAFVLKTPSAAYLWVGTGASEAEKTGAQELLRVLRAQPVQVAEGSEPDGFWEALGGKAAYRTSPRLKDKKMDAHPPRLFACSNKIGRFVIEEVPGELMQEDLATDDVMLLDTWDQVFVWVGKDSQEEEKTEALTSAKRYIETDPANRDRRTPITVVKQGFEPPSFVGWFLGWDDDYWSVDPLDRAMAELAA

SEQ ID NO: 376 - protein, 731 aa, Homo sapiens; identical to SEQ ID NO: 375

SEQ ID NO: 377 - protein, 742 aa, Homo sapiens
MEKLFCCFPNSMVVEHPEFLKAGKEPGLQIWRVEKFDLVPVPTNLYGDFFTGDAYVILKTVQLRNGNLQYDLHYWLGNECSQDESGAAAIFTVQLDDYLNGRAVQHREVQGFESATFLGYFKSGLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPEAMLQVLGPKPALPAGTEDTAKEDAANRKLAKLYKVSNGAGTMSVSLVADENPFAQGALKSEDCFILDHGKDGKIFVWKGKQANTEERKAALKTASDFITKMDYPKQTQVSVLPEGGETPLFKQFFKNWRDPDQTDGLGLSYLSSHIANVERVPFDAATLHTSTAMAAQHGMDDDGTGQKQIWRIEGSNKVPVDPATYGQFYGGDSYIILYNYRHGGRQGQIIYNWQGAQSTQDEVAASAILTAQLDEELGGTPVQSRVVQGKEPAHLMSLFGGKPMIIYKGGTSREGGQTAPASTRLFQVRANSAGATRAVEVLPKAGALNSNDAFVLKTPSAAYLWVGTGASEAEKTGAQELLRVLRAQPVQVAEGSEPDGFWEALGGKAAYRTSPRLKDKKMDAHPPRLFACSNKIGRFVIEEVPGELMQEDLATDDVMLLDTWDQVFVWVGKDSQEEEKTEALTSAKRYIETDPANRDRRTPITVVKQGFEPPSFVGWFLGWDDDYWSVDPLDRAMAELAA

SEQ ID NO: 378 - protein, 782 aa, Homo sapiens
MAPHRPAPALLCALSLALCALSLPVRAATASRGASQAGAPQGRVPEARPNSMVVEHPEFLKAGKEPGLQIWRVEKFDLVPVPTNLYGDFFTGDAYVILKTVQLRNGNLQYDLHYWLGNECSQDESGAAAIFTVQLDDYLNGRAVQHREVQGFESATFLGYFKSGLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPEAMLQVLGPKPALPAGTEDTAKEDAANRKLAKLYKVSNGAGTMSVSLVADENPFAQGALKSEDCFILDHGKDGKIFVWKGKQANTEERKAALKTASDFITKMDYPKQTQVSVLPEGGETPLFKQFFKNWRDPDQTDGLGLSYLSSHIANVERVPFDAATLHTSTAMAAQHGMDDDGTGQKQIWRIEGSNKVPVDPATYGQFYGGDSYIILYNYRHGGRQGQIIYNWQGAQSTQDEVAASAILTAQLDEELGGTPVQSRVVQGKEPAHLMSLFGGKPMIIYKGGTSREGGQTAPASTRLFQVRANSAGATRAVEVLPKAGALNSNDAFVLKTPSAAYLWVGTGASEAEKTGAQELLRVLRAQPVQVAEGSEPDGFWEALGGKAAYRTSPRLKDKKMDAHPPRLFACSNKIGRFVIEEVPGELMQEDLATDDVMLLDTWDQVFVWVGKDSQEEEKTEALTSAKRYIETDPANRDRRTPITVVKQGFEPPSFVGWFLGWDDDYWSVDPLDRAMAELAA

SEQ ID NO: 379 - protein, 782 aa, Homo sapiens; identical to SEQ ID NO: 378

SEQ ID NO: 380 - protein, 588 aa, Homo sapiens [sequence omitted]

SEQ ID NO: 381 - protein, 669 aa, Homo sapiens [sequence omitted]

SEQ ID NO: 382 - protein, 587 aa, Homo sapiens
MASEDIAKLAETLAKTQVAGGQLSFKGKSLKLNTAEDAKDVIKEIEDFDSLEALRLEGNTVGVEAARVIAKALEKKSELKRCHWSDMFTGRLRTEIPPALISLGEGLITAGAQLVELDLSDNAFGPDGVQGFEALLKSSACFTLQELKLNNCGMGIGGGKILAAALTECHRKSSAQGKPLALKVFVAGRNRLENDGATALAEAFRVIGTLEEVHMPQNGINHPGITALAQAFAVNPLLRVINLNDNTFTEKGAVAMAETLKTLRQVEVINFGDCLVRSKGAVAIADAIRGGLPKLKELNLSFCEIKRDAALAVAEAMADKAELEKLDLNGNTLGEEGCEQLQEVLEGFNMAKVLASLSDDEDEEEEEEGEEEEEEAEEEEEEDEEEEEEEEEEEEEEPQQRGQGEKSATPSRKILDPNTGEPAPVLSSPPPADVSTFLAFPSPEKLLRLGPKSSVLIAQQTDTSDPEKVVSAFLKVSSVFKDEATVRMAVQDAVDALMQKAFNSSSFNSNTFLTRLLVHMGLLKSEDKVKAIANLYGPLMALNHMVQQDYFPKALAPLLLAFVTKPNSALESCSFARHSLLQTLYKV

SEQ ID NO: 383 - protein, 587 aa, Homo sapiens; identical to SEQ ID NO: 382

SEQ ID NO: 384 - protein, 587 aa, Homo sapiens; identical to SEQ ID NO: 382

SEQ ID NO: 385 - protein, 587 aa, Homo sapiens; identical to SEQ ID NO: 382

SEQ ID NO: 386 - protein, 615 aa, Homo sapiens [sequence omitted]

SEQ ID NO: 387 - protein, 711 aa, Homo sapiens [sequence omitted]

SEQ ID NO: 388 - protein, 711 aa, Homo sapiens [sequence omitted]

SEQ ID NO: 389 - protein, 711 aa, Homo sapiens
MKLVFLVLLFLGALGLCLAGRRRRSVQWCAVSQPEATKCFQWQRNMRKVRGPPVSCIKRDSPIQCIQAIAENRADAVTLDGGFIYEAGLAPYKLRPVAAEVYGTERQPRTHYYAVAVVKKGGSFQLNELQGLKSCHTGLRRTAGWNVPTGTLRPFLNWTGPPEPIEAAVARFFSASCVPGADKGQFPNLCRLCAGTGENKCAFSSQEPYFSYSGAFKCLRDGAGDVAFIRESTVFEDLSDEAERDEYELLCPDNTRKPVDKFKDCHLARVPSHAVVARSVNGKEDAIWNLLRQAQEKFGKDKSPKFQLFGSPSGQKDLLFKDSAIGFSRVPPRIDSGLYLGSGYFTAIQNLRKSEEEVAARRARVVWCAVGEQELRKCNQWSGLSEGSVTCSSASTTEDCIALVLKGEADAMSLDGGYVYTACKCGLVPVLAENYKSQQSSDPDPNCVDRPVEGYLAVAVVRRSDTSLTWNSVKGKKSCHTAVDRTAGWNIPMGLLFNQTGSCKFDEYFSQSCAPGSDPRSNLCALCIGDEQGENKCVPNSNERYYGYTGAFRCLAENAGDVAFVKDVTVLQNTDGNNNEAWAKDLKLADFALLCLDGKRKPVTEARSCHLAMAPNHAVVSRMDKVERLKQVLLHQQAKFGRNGSDCPDKFCLFQSETKNLLFNDNTECLARLHGKTTYEKYLGPQYVAGITNLKKCSTSPLLEACEFLRK

SEQ ID NO: 390 - protein, 77 aa, Homo sapiens
MLSILVTSRVTVSSLSDVWPLSCSAPFSVRHAASTLKPRASSCLASRFPKPESQPVIKTYLSWRWLTTCLSRYQCRR

SEQ ID NO: 391 - protein, 189 aa, Homo sapiens
MASKRALVILAKGAEEMETVIPVDVMRRAGIKVTVAGLAGKDPVQCSRDVVICPDASLEDAKKEGPYDVVVLPGGNLGAQNLSESAAVKEILKEQENRKGLIAAICAGPTALLAHEIGFGSKVTTHPLAKDKMMNGGHYTYSENRVEKDGLILTSRGPGTSFEFALAIVEALNGKEVAAQVKAPLVLKD

SEQ ID NO: 392 - protein, 189 aa, Homo sapiens; identical to SEQ ID NO: 391

SEQ ID NO: 393 - protein, 4127 aa, Homo sapiens
MAGSGAGVRCSLLRLQETLSAADRCGAALAGHQLIRGLGQECVLSSSPAVLALQTSLVFSRDFGLLVFVRKSLNSIEFRECREEILKFLCIFLEKMGQKIAPYSVEIKNTCTSVYTKDRAAKCKIPALDLLIKLLQTFRSSRLMDEFKIGELFSKFYGELALKKKIPDTVLEKVYELLGLLGEVHPSEMINNAENLFRAFLGELKTQMTSAVREPKLPVLAGCLKGLSSLLCNFTKSMEEDPQTSREIFNFVLKAIRPQIDLKRYAVPSAGLRLFALHASQFSTCLLDNYVSLFEVLLKWCAHTNVELKKAALSALESFLKQVSNMVAKNAEMHKNKLQYFMEQFYGIIRNVDSNNKELSIAIRGYGLFAGPCKVINAKDVDFMYVELIQRCKQMFLTQTDTGDDRVYQMPSFLQSVASVLLYLDTVPEVYTPVLEHLVVMQIDSFPQYSPKMQLVCCRAIVKVFLALAAKGPVLRNCISTVVHQGLIRICSKPVVLPKGPESESEDHRASGEVRTGKWKVPTYKDYVDLFRHLLSSDQMMDSILADEAFFSVNSSSESLNHLLYDEFVKSVLKIVEKLDLTLEIQTVGEQENGDEAPGVWMIPTSDPAANLHPAKPKDFSAFINLVEFCREILPEKQAEFFEPWVYSFSYELILQSTRLPLISGFYKLLSITVRNAKKIKYFEGVSPKSLKHSPEDPEKYSCFALFVKFGKEVAVKMKQYKDELLASCLTFLLSLPHNIIELDVRAYVPALQMAFKLGLSYTPLAEVGLNALEEWSIYIDRHVMQPYYKDILPCLDGYLKTSALSDETKNNWEVSALSRAAQKGFNKVVLKHLKKTKNLSSNEAISLEEIRIRVVQMLGSLGGQINKNLLTVTSSDEMMKSYVAWDREKRLSFAVPFREMKPVIFLDVFLPRVTELALTASDRQTKVAACELLHSMVMFMLGKATQMPEGGQGAPPMYQLYKRTFPVLLRLACDVDQVTRQLYEPLVMQLIHWFTNNKKFESQDTVALLEAILDGIVDPVDSTLRDFCGRCIREFLKWSIKQITPQQQEKSPVNTKSLFKRLYSLALHPNAFKRLGASLAFNNIYREFREEESLVEQFVFEALVIYMESLALAHADEKSLGTIQQCCDAIDHLCRIIEKKHVSLNKAKKRRLPRGFPPSASLCLLDLVKWLLAHCGRPQTECRHKSIELFYKFVPLLPGNRSPNLWLKDVLKEEGVSFLINTFEGGGCGQPSGILAQPTLLYLRGPFSLQATLCWLDLLLAALECYNTFIGERTVGALQVLGTEAQSSLLKAVAFFLESIAMHDIIAAEKCFGTGAAGNRTSPQEGERYNYSKCTVVVRIMEFTTTLLNTSPEGWKLLKKDLCNTHLMRVLVQTLCEPASIGFNIGDVQVMAHLPDVCVNLMKALKMSPYKDILETHLREKITAQSIEELCAVNLYGPDAQVDRSRLAAVVSACKQLHRAGLLHNILPSQSTDLHHSVGTELLSLVYKGIAPGDERQCLPSLDLSCKQLASGLLELAFAFGGLCERLVSLLLNPAVLSTASLGSSQGSVIHFSHGEYFYSLFSETINTELLKNLDLAVLELMQSSVDNTKMVSAVLNGMLDQSFRERANQKHQGLKLATTILQHWKKCDSWWAKDSPLETKMAVLALLAKILQIDSSVSFNTSHGSFPEVFTTYISLLADTKLDLHLKGQAVTLLPFFTSLTGGSLEELRRVLEQLIVAHFPMQSREFPPGTPRFNNYVDCMKKFLDALELSQSPMLLELMTEVLCREQQHVMEELFQSSFRRIARRGSCVTQVGLLESVYEMFRKDDPRLSFTRQSFVDRSLLTLLWHCSLDALREFFSTIVVDAIDVLKSRFTKLNESTFDTQITKKMGYYKILDVMYSRLPKDDVHAKESKINQVFHGSCITEGNELTKTLIKLCYDAFTENMAGENQLLERRRLYHCAAYNCAISVICCVFNELKFYQGFLFSEKPEKNLLIFENLIDLKRRYNFPVEVEVPMERKKKYIEIRKEAREAANGDSDGPSYMSSLSYLADSTLSEEMSQFDFSTGVQSYSYSSQDPRPATGRFRRREQRDPTVHDDVLELEMDELNRHECMAPLTALVKHMHRSLGPPQGEEDSVPRDLPSWMKFLHGKLGNPIVPLNIRLFLAKLVINTEEVFRPYAKHWLSPLLQLAASENNGGEGIHYMVVEIVATILSWTGLATPTGVPKDEVLANRLLNFLMKHVFHPKRAVFRHNLEIIKTLVECWKDCLSIPYRLIFEKFSGKDPNSKDNSVGIQLLGIVMANDLPPYDPQCGIQSSEYFQALVNNMSFVRYKEVYAAAAEVLGLILRYVMERKNILEESLCELVAKQLKQHQNTMEDKFIVCLNKVTKSFPPLADRFMNAVFFLLPKFHGVLKTLCLEVVLCRVEGMTELYFQLKSKDFVQVMRHRDDERQKVCLDIIYKMMPKLKPVELRELLNPVVEFVSHPSTTCREQMYNILMWIHDNYRDPESETDNDSQEIFKLAKDVLIQGLIDENPGLQLIIRNFWSHETRLPSNTLDRLLALNSLYSPKIEVHFLSLATNFLLEMTSMSPDYPNPMFEHPLSECEFQEYTIDSDWRFRSTVLTPMFVETQASQGTLQTRTQEGSLSARWPVAGQIRATQQQHDFTLTQTADGRSSFDWLTGSSTDPLVDHTSPSSDSLLFAHKRSERLQRAPLKSVGPDFGKKRLGLPGDEVDNKVKGAAGRTDLLRLRRRFMRDQEKLSLMYARKGVAEQKREKEIKSELKMKQDAQVVLYRSYRHGDLPDIQIKHSSLITPLQAVAQRDPIIAKQLFSSLFSGILKEMDKFKTLSEKNNITQKLLQDFNRFLNTTFSFFPPFVSCIQDISCQHAALLSLDPAAVSAGCLASLQQPVGIRLLEEALLRLLPAELPAKRVRGKARLPPDVLRWVELAKLYRSIGEYDVLRGIFTSEIGTKQITQSALLAEARSDYSEAAKQYDEALNKQDWVDGEPTEAEKDFWELASLDCYNHLAEWKSLEYCSTASIDSENPPDLNKIWSEPFYQETYLPYMIRSKLKLLLQGEADQSLLTFIDKAMHGELQKAILELHYSQELSLLYLLQDDVDRAKYYIQNGIQSFMQNYSSIDVLLHQSRLTKLQSVQALTEIQEFISFISKQGNLSSQVPLKRLLNTWTNRYPDAKMDPMNIWDDIITNRCFFLSKIEEKLTPLPEDNSMNVDQDGDPSDRMEVQEQEEDISSLIRSCKFSMKMKMIDSARKQNNFSLAMKLLKELHKESKTRDDWLVSWVQSYCRLSHCRSRSQGCSEQVLTVLKTVSLLDENNVSSYLSKNILAFRDQNILLGTTYRIIANALSSEPACLAEIEEDKARRILELSGSSSEDSEKVIAGLYQRAFQHLSEAVQAAEEEAQPPSWSCGPAAGVIDAYMTLADFCDQQLRKEEENASVIDSAELQAYPALVVEKMLKALKLNSNEARLKFPRLLQIIERYPEETLSLMTKEISSVPCWQFISWISHMVALLDKDQAVAVQHSVEEITDNYPQAIVYPFIISSESYSFKDTSTGHKNKEFVARIKSKLDQGGVIQDFINALDQLSNPELLFKDWSNDVRAELAKTPVNKKNIEKMYERMYAALGDPKAPGLGAFRRKFIQTFGKEFDKHFGKGGSKLLRMKLSDFNDITNMLLLKMNKDSKPPGNLKECSPWMSDFKVEFLRNELEIPGQYDGRGKPLPEYHVRIAGFDERVVMASLRRPKRIIIRGHDEREHPFLVKGGEDLRQDQRVEQLFQVMNGILAQDSACSQRALQLRTYSVVPMTSRLGLIEWLENTVTLKDLLLNTMSQEEKAAYLSDPRAPPCEYKDWLTKMSGKHDVGAYMLMYKGANRTETVTSFRKRESKVPADLLKRAFVRMSTSPEAFLALRSHFASSHALICISHWILGIGDRHLNNFMVAMETGGVIGIDFGHAFGSATQFLPVPELMPFRLTRQFINLMLPMKETGLMYSIMVHALRAFRSDPGLLTNTMDVFVKEPSFDWKNFEQKMLKKGGSWIQEINVAEKNWYPRQKICYAKRKLAGANPAVITCDELLLGHEKAPAFRDYVAVARGSKDHNIRAQEPESGLSEETQVKCLMDQATDPNILGRTWEGWEPWM

SEQ ID NO: 394 - protein, 4128 aa, Homo sapiens [sequence omitted]

SEQ ID NO: 395 - protein, 4096 aa, Homo sapiens
MAGSGAGVRCSLLRLQETLSAADRCGAALAGHQLIRGLGQECVLSSSPAVLALQTSLVFSRDFGLLVFVRKSLNSIEFRECREEILKFLCIFLEKMGQKIAPYSVEIKNTCTSVYTKDRAAKCKIPALDLLIKLLQTFRSSRLMDEFKIGELFSKFYGELALKKKIPDTVLEKVYELLGLLGEVHPSEMINNAENLFRAFLGELKTQMTSAVREPKLPVLAGCLKGLSSLLCNFTKSMEEDPQTSREIFNFVLKAIRPQIDLKRYAVPSAGLRLFALHASQFSTCLLDNYVSLFEVLLKWCAHTNVELKKAALSALESFLKQVSNMVAKNAEMHKNKLQYFMEQFYGIIRNVDSNNKELSIAIRGYGLFAGPCKVINAKDVDFMYVELIQRCKQMFLTQTDTGDDRVYQMPSFLQSVASVLLYLDTVPEVYTPVLEHLVVMQIDSFPQYSPKMQLVCCRAIVKVFLALAAKGPVLRNCISTVVHQGLIRICSKPVVLPKGPESESEDHRASGEVRTGKWKVPTYKDYVDLFRHLLSSDQMMDSILADEAFFSVNSSSESLNHLLYDEFVKSVLKIVEKLDLTLEIQTVGEQENGDEAPGVWMIPTSDPAANLHPAKPKDFSAFINLVEFCREILPEKQAEFFEPWVYSFSYELILQSTRLPLISGFYKLLSITVRNAKKIKYFEGVSPKSLKHSPEDPEKYSCFALFVKFGKEVAVKMKQYKDELLASCLTFLLSLPHNIIELDVRAYVPALQMAFKLGLSYTPLAEVGLNALEEWSIYIDRHVMQPYYKDILPCLDGYLKTSALSDETKNNWEVSALSRAAQKGFNKVVLKHLKKTKNLSSNEAISLEEIRIRVVQMLGSLGGQINKNLLTVTSSDEMMKSYVAWDREKRLSFAVPFREMKPVIFLDVFLPRVTELALTASDRQTKVAACELLHSMVMFMLGKATQMPEGGQGAPPMYQLYKRTFPVLLRLACDVDQVTRQLYEPLVMQLIHWFTNNKKFESQDTVALLEAILDGIVDPVDSTLRDFCGRCIREFLKWSIKQITPQQQEKSPVNTKSLFKRLYSLALHPNAFKRLGASLAFNNIYREFREEESLVEQFVFEALVIYMESLALAHADEKSLGTIQQCCDAIDHLCRIIEKKHVSLNKAKKRRLPRGFPPSASLCLLDLVKWLLAHCGRPQTECRHKSIELFYKFVPLLPGNRSPNLWLKDVLKEEGVSFLINTFEGGGCGQPSGILAQPTLLYLRGPFSLQATLCWLDLLLAALECYNTFIGERTVGALQVLGTEAQSSLLKAVAFFLESIAMHDIIAAEKCFGTGAAGNRTSPQEGERYNYSKCTVVVRIMEFTTTLLNTSPEGWKLLKKDLCNTHLMRVLVQTLCEPASIGFNIGDVQVMAHLPDVCVNLMKALKMSPYKDILETHLREKITAQSIEELCAVNLYGPDAQVDRSRLAAVVSACKQLHRAGLLHNILPSQSTDLHHSVGTELLSLVYKGIAPGDERQCLPSLDLSCKQLASGLLELAFAFGGLCERLVSLLLNPAVLSTASLGSSQGSVIHFSHGEYFYSLFSETINTELLKNLDLAVLELMQSSVDNTKMVSAVLNGMLDQSFRERANQKHQGLKLATTILQHWKKCDSWWAKDSPLETKMAVLALLAKILQIDSSVSFNTSHGSFPEVFTTYISLLADTKLDLHLKGQAVTLLPFFTSLTGGSLEELRRVLEQLIVAHFPMQSREFPPGTPRFNNYVDCMKKFLDALELSQSPMLLELMTEVLCREQQHVMEELFQSSFRRIARRGSCVTQVGLLESVYEMFRKDDPRLSFTRQSFVDRSLLTLLWHCSLDALREFFSTIVVDAIDVLKSRFTKLNESTFDTQITKKMGYYKILDVMYSRLPKDDVHAKESKINQVFHGSCITEGNELTKTLIKLCYDAFTENMAGENQLLERRRLYHCAAYNCAISVICCVFNELKFYQGFLFSEKPEKNLLIFENLIDLKRRYNFPVEVEVPMERKKKYIEIRKEAREAANGDSDGPSYMSSLSYLADSTLSEEMSQFDFSTGVQSYSYSSQDPRPATGRFRRREQRDPTVHDDVLELEMDELNRHECMAPLTALVKHMHRSLGPPQGEEDSVPRDLPSWMKFLHGKLGNPIVPLNIRLFLAKLVINTEEVFRPYAKHWLSPLLQLAASENNGGEGIHYMVVEIVATILSWTGLATPTGVPKDEVLANRLLNFLMKHVFHPKRAVFRHNLEIIKTLVECWKDCLSIPYRLIFEKFSGKDPNSKDNSVGIQLLGIVMANDLPPYDPQCGIQSSEYFQALVNNMSFVRYKEVYAAAAEVLGLILRYVMERKNILEESLCELVAKQLKQHQNTMEDKFIVCLNKVTKSFPPLADRFMNAVFFLLPKFHGVLKTLCLEVVLCRVEGMTELYFQLKSKDFVQVMRHRDDERQKVCLDIIYKMMPKLKPVELRELLNPVVEFVSHPSTTCREQMYNILMWIHDNYRDPESETDNDSQEIFKLAKDVLIQGLIDENPGLQLIIRNFWSHETRLPSNTLDRLLALNSLYSPKIEVHFLSLATNFLLEMTSMSPDYPNPMFEHPLSECEFQEYTIDSDWRFRSTVLTPMFVETQASQGTLQTRTQEGSLSARWPVAGQIRATQQQHDFTLTQTADGRSSFDWLTGSSTDPLVDHTSPSSDSLLFAHKRSERLQRAPLKSVGPDFGKKRLGLPGDEVDNKVKGAAGRTDLLRLRRRFMRDQEKLSLMYARKGVAEQKREKEIKSELKMKQDAQVVLYRSYRHGDLPDIQIKHSSLITPLQAVAQRDPIIAKQLFSSLFSGILKEMDKFKTLSEKNNITQKLLQDFNRFLNTTFSFFPPFVSCIQDISCQHAALLSLDPAAVSAGCLASLQQPVGIRLLEEALLRLLPAELPAKRVRGKARLPPDVLRWVELAKLYRSIGEYDVLRGIFTSEIGTKQITQSALLAEARSDYSEAAKQYDEALNKQDWVDGEPTEAEKDFWELASLDCYNHLAEWKSLEYCSTASIDSENPPDLNKIWSEPFYQETYLPYMIRSKLKLLLQGEADQSLLTFIDKAMHGELQKAILELHYSQELSLLYLLQDDVDRAKYYIQNGIQSFMQNYSSIDVLLHQSRLTKLQSVQALTEIQEFISFISKQGNLSSQVPLKRLLNTWTNRYPDAKMDPMNIWDDIITNRCFFLSKIEEKLTPLPEDNSMNVDQDGDPSDRMEVQEQEEDISSLIRSCKFSMKMKMIDSARKQNNFSLAMKLLKELHKESKTRDDWLVSWVQSYCRLSHCRSRSQGCSEQVLTVLKTVSLLDENNVSSYLSKNILAFRDQNILLGTTYRIIANALSSEPACLAEIEEDKARRILELSGSSSEDSEKVIAGLYQRAFQHLSEAVQAAEEEAQPPSWSCGPAAGVIDAYMTLADFCDQQLRKEEENASVIDSAELQAYPALVVEKMLKALKLNSNEARLKFPRLLQIIERYPEETLSLMTKEISSVPCWQFISWISHMVALLDKDQAVAVQHSVEEITDNYPQAIVYPFIISSESYSFKDTSTGHKNKEFVARIKSKLDQGGVIQDFINALDQLSNPELLFKDWSNDVRAELAKTPVNKKNIEKMYERMYAALGDPKAPGLGAFRRKFIQTFGKEFDKHFGKGGSKLLRMKLSDFNDITNMLLLKMNKDSKPPGNLKECSPWMSDFKVEFLRNELEIPGQYDGRGKPLPEYHVRIAGFDERVVMASLRRPKRIIIRGHDEREHPFLVKGGEDLRQDQRVEQLFQVMNGILAQDSACSQRALQLRTYSVVPMTSSDPRAPPCEYKDWLTKMSGKHDVGAYMLMYKGANRTETVTSFRKRESKVPADLLKRAFVRMSTSPEAFLALRSHFASSHALICISHWILGIGDRHLNNFMVAMETGGVIGIDFGHAFGSATQFLPVPELMPFRLTRQFINLMLPMKETGLMYSIMVHALRAFRSDPGLLTNTMDVFVKEPSFDWKNFEQKMLKKGGSWIQEINVAEKNWYPRQKICYAKRKLAGANPAVITCDELLLGHEKAPAFRDYVAVARGSKDHNIRAQEPESGLSEETQVKCLMDQATDPNILGRTWEGWEPWM

SEQ ID NO: 396 - protein, 4096 aa, Homo sapiens
MAGSGAGVRCSLLRLQETLSAADRCGAALAGHQLIRGLGQECVLSSSPAVLALQTSLVFSRDFGLLVFVRKSLNSIEFRECREEILKFLCIFLEKMGQKIAPYSVEIKNTCTSVYTKDRAAKCKIPALDLLIKLLQTFRSSRLMDEFKIGELFSKFYGELALKKKIPDTVLEKVYELLGLLGEVHPSEMINNAENLFRAFLGELKTQMTSAVREPKLPVLAGCLKGLSSLLCNFTKSMEEDPQTSREIFNFVLKAIRPQIDLKRYAVPSAGLRLFALHASQFSTCLLDNYVSLFEVLLKWCAHTNVELKKAALSALESFLKQVSNMVAKNAEMHKNKLQYFMEQFYGIIRNVDSNNKELSIAIRGYGLFAGPCKVINAKDVDFMYVELIQRCKQMFLTQTDTGDYRVYQMPSFLQSVASVLLYLDTVPEVYTPVLEHLVVMQIDSFPQYSPKMQLVCCRAIVKVFLALAAKGPVLRNCISTVVHQGLIRICSKPVVLPKGPESESEDHRASGEVRTGKWKVPTYKDYVDLFRHLLSSDQMMDSILADEAFFSVNSSSESLNHLLYDEFVKSVLKIVEKLDLTLEIQTVGEQENGDEAPGVWMIPTSDPAANLHPAKPKDFSAFINLVEFCREILPEKQAEFFEPWVYSFSYELILQSTRLPLISGFYKLLSITVRNAKKIKYFEGVSPKSLKHSPEDPEKYSCFALFVKFGKEVAVKMKQYKDELLASCLTFLLSLPHNIIELDVRAYVPALQMAFKLGLSYTPLAEVGLNALEEWSIYIDRHVMQPYYKDILPCLDGYLKTSALSDETKNNWEVSALSRAAQKGFNKVVLKHLKKTKNLSSNEAISLEEIRIRVVQMLGSLGGQINKNLLTVTSSDEMMKSYVAWDREKRLSFAVPFREMKPVIFLDVFLPRVTELALTASDRQTKVAACELLHSMVMFMLGKATQMPEGGQGAPPMYQLYKRTFPVLLRLACDVDQVTRQLYEPLVMQLIHWFTNNKKFESQDTVSLLEAILDGIVDPVDSTLRDFCGRCIREFLKWSIKQITPQQQEKSPVNTKSLFKRLYSLALHPNAFKRLGASLAFNNIYREFREEESLVEQFVFEALVIYMESLALAHADEKSLGTIQQCCDAIDHLCRIIEKKHVSLNKAKKRRLPRGFPPSASLCLLDLVKWLLAHCGRPQTECRHKSIELFYKFVPLLPGNRSPNLWLKDVLKEEGVSFLINTFEGGGCGQPSGILAQPTLLYLRGPFSLQATLCWLDLLLAALECYNTFIGERTVGALQVLGTEAQSSLLKAVAFFLESIAMHDIIAAEKCFGTGAAGNRTSPQEGERYNYSKCTVVVRIMEFTTTLLNTSPEGWKLLKKDLCNTHLMRVLVQTLCEPASIGFNIGDVQVMAHLPDVCVNLMKALKMSPYKDILETHLREKITAQSIEELCAVNLYGPDAQVDRSRLAAVVSACKQLHRAGLLHNILPSQSTDLHHSVGTELLSLVYKGIAPGDERQCLPSLDLSCKQLASGLLELAFAFGGLCERLVSLLLNPAVLSTASLGSSQGSVIHFSHGEYFYSLFSETINTELLKNLDLAVLELMQSSVDNTKMVSAVLNGMLDQSFRERANQKHQGLKLATTILQHWKKCDSWWAKDSPLETKMAVLALLAKILQIDSSVSFNTSHGSFPEVFTTYISLLADTKLDLHLKGQAVTLLPFFTSLTGGSLEELRRVLEQLIVAHFPMQSREFPPGTPRFNNYVDCMKKFLDALELSQSPMLLELMTEVLCREQQHVMEELFQSSFRRIARRGSCVTQVGLLESVYEMFRKDDPRLSFTRQSFVDRSLLTLLWHCSLDALREFFSTIVVDAIDVLKSRFTKLNESTFDTQITKKMGYYKILDVMYSRLPKDDVHAKESKINQVFHGSCITEGNELTKTLIKLCYDAFTENMAGENQLLERRRLYHCAAYNCAISVICCVFNELKFYQGFLFSEKPEKNLLIFENLIDLKRRYNFPVEVEVPMERKKKYIEIRKEAREAANGDSDGPSYMSSLSYLADSTLSEEMSQFDFSTGVQSYSYSSQDPRPATGRFRRREQRDPTVHDDVLELEMDELNRHECMAPLTALVKHMHRSLGPPQGEEDSVPRDLPSWMKFLHGKLGNPIVPLNIRLFLAKLVINTEEVFRPYAKHWLSPLLQLAASENNGGEGIHYMVVEIVATILSWTGLATPTGVPKDEVLANRLLNFLMKHVFHPKRAVFRHNLEIIKTLVECWKDCLSIPYRLIFEKFSGKDPNSKDNSVGIQLLGIVMANDLPPYDPQCGIQSSEYFQALVNNMSFVRYKEVYAAAAEVLGLILRYVMERKNILEESLCELVAKQLKQHQNTMEDKFIVCLNKVTKSFPPLADRFMNAVFFLLPKFHGVLKTLCLEVVLCRVEGMTELYFQLKSKDFVQVMRHRDERQKVCLDIIYKMMPKLKPVELRELLNPVVEFVSHPSTTCREQMYNILMWIHDNYRDPESETDNDSQEIFKLAKDVLIQGLIDENPGLQLIIRNFWSHETRLPSNTLDRLLALNSLYSPKIEVHFLSLATNFLLEMTSMSPDYPNPMFEHPLSECEFQEYTIDSDWRFRSTVLTPMFVETQASQGTLQTRTQEGSLSARWPVAGQIRATQQQHDFTLTQTADGRSSFDWLTGSSTDPLVDHTSPSSDSLLFAHKRSERLQRAPLKSVGPDFGKKRLGLPGDEVDNKVKGAAGRTDLLRLRRRFMRDQEKLSLMYARKGVAEQKREKEIKSELKMKQDAQVVLYRSYRHGDLPDIQIKHSSLITPLQAVAQRDPIIAKQLFSSLFSGILKEMDKFKTLSEKNNITQKLLQDFNRFLNTTFSFFPPFVSCIQDISCQHAALLSLDPAAVSAGCLASLQQPVGIRLLEEALLRLLPAELPAKRVRGKARLPPDVLRWVELAKLYRSIGEYDVLRGIFTSEIGTKQITQSALLAEARSDYSEAAKQYDEALNKQDWVDGEPTEAEKDFWELASLDCYNHLAEWKSLEYCSTASIDSENPPDLNKIWSEPFYQETYLPYMIRSKLKLLLQGEADQSLLTFIDKAMHGELQKAILELHYSQELSLLYLLQDDVDRAKYYIQNGIQSFMQNYSSIDVLLHQSRLTKLQSVQALTEIQEFISFISKQGNLSSQVPLKRLLNTWTNRYPDAKMDPMNIWDDIITNRCFFLSKIEEKLTPLPEDNSMNVDQDGDPSDRMEVQEQEEDISSLIRSCKFSMKMKMIDSARKQNNFSLAMKLLKELHKESKTRDDWLVSWVQSYCRLSHCRSRSQGCSEQVLTVLKTVSLLDENNVSSYLNKNILAFRDQNILLGTTYRIIANALSSEPACLAEIEEDKARRILELSGSSSEDSEKVIAGLYQRAFQHLSEAVQAAEEEAQPPSWSCGPAAGVIDAYMTLADFCDQQLRKEEENASVTDSAELQAYPALVVEKMLKALKLNSNEARLKFPRLLQIIERYPEETLSLMTKEISSVPCWQFISWISHMVALLDKDQAVAVQHSVEEITDNYPQAIVYPFIISSESYSFKDTSTGHKNKEFVARIKSKLDQGGVIQDFINALDQLSNPELLFKDWSNDVRAELAKTPVNKKNIEKMYERMYAALGDPKAPGLGAFRRKFIQTFGKEFDKHFGKGGSKLLRMKLSDFNDITNMLLLKMNKDSKPPGNLKECSPWMSDFKVEFLRNELEIPGQYDGRGKPLPEYHVRIAGFDERVTVMASLRRPKRIIIRGHDEREHPFLVKGGEDLRQDQRVEQLFQVMNGILAQDSACSQRALQLRTYSVVPMTSSDPRAPPCEYKDWLTKMSGKHDVGAYMLMYKGANRTETVTSFRKRESKVPADLLKRAFVRMSTSPEAFLALRSHFASSHALICISHWILGIGDRHLNNFMVAMETGGVIGIDFGHAFGSATQFLPVPELMPFRLTRQFINLMLPMKETGLMYSIMVHALRAFRSDPGLLTNTMDVFVKEPSFDWKNFEQKMLKKGGSWIQEINVAEKNWYPRQKICYAKRKLAGANPAVITCDELLLGHEKAPAFRDYVAVARGSKDHNIRAQEPESGLSEETQVKCLMDQATDPNILGRTWEGWEPWM

SEQ ID NO: 397 - protein, 4128 aa, Homo sapiens [sequence omitted]

SEQ ID NO: 398 - protein, 534 aa, Homo sapiens [sequence omitted]

SEQ ID NO: 399 - protein, 606 aa, Homo sapiens [sequence omitted]

SEQ ID NO: 400 - protein, 545 aa, Homo sapiens [sequence omitted]

SEQ ID NO: 401 - protein, 619 aa, Homo sapiens [sequence omitted]

SEQ ID NO: 402 - protein, 606 aa, Homo sapiens
MPYEIKKVFASLPQVERGVSKIIGGDPKGNNFLYTNGKCVILRNIDNPALADIYTEHAHQVVVAKYAPSGFYIASGDVSGKLRIWDTTQKEHLLKYEYQPFAGKIKDIAWTEDSKRIAVVGEGREKFGAVFLWDSGSSVGEITGHNKVINSVDIKQSRPYRLATGSDDNCAAFFEGPPFKFKFTIGDHSRFVNCVRFSPDGNRFATASADGQIYIYDGKTGEKVCALGGSKAHDGGIYAISWSPDSTHLLSASGDKTSKIWDVSVNSVVSTFPMGSTVLDQQLGCLWQKDHLLSVSLSGYINYLDRNNPSKPLHVIKGHSKSIQCLTVHKNGGKSYIYSGSHDGHINYWDSETGENDSFAGKGHTNQVSRMTVDESGQLISCSMDDTVRYTSLMLRDYSGQGVVKLDVQPKCVAVGPGGYAVVVCIGQIVLLKDQRKCFSIDNPGYEPEVVAVHPGGDTVAIGGVDGNVRLYSILGTTLKDEGKLLEAKGPVTDVAYSHDGAFLAVCDASKVVTVFSVADGYSENNVFYGHHAKIVCLAWSPDNEHFASGGMDMMVYVWTLSDPETRVKIQDAHRLHHVSSLAWLDEHTLVTTSHDASVKEWTITY

SEQ ID NO: 403 - protein, 181 aa, Homo sapiens
MFKKFDEKENVSNCIQLKTSVIKGIKNQLIEQFPGIEPWLNQIMPKKDPVKIVRCHEHIEILTVNGELLFFRQREGPFYPTLRLLHKYPFILPHQQVDKGAIKFVLSGANIMCPGLTSPGAKLYPAAVDTIVAIMAEGKQHALCVGVMKMSAEDIEKVNKGIGIENIHYLNDGLWHMKTYK

SEQ ID NO: 404 - protein, 138 aa, Homo sapiens
MPKKDPVKIVRCHEHIEILTVNGELLFFRQREGPFYPTLRLLHKYPFILPHQQVDKGAIKFVLSGANIMCPGLTSPGAKLYPAAVDTIVAIMAEGKQHALCVGVMKMSAEDIEKVNKGIGIENIHYLNDGLWHMKTYK

SEQ ID NO: 405 - protein, 181 aa, Homo sapiens; identical to SEQ ID NO: 403

SEQ ID NO: 406 - protein, 181 aa, Homo sapiens; identical to SEQ ID NO: 403

SEQ ID NO: 407 - protein, 702 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 408 - protein, 702 aa, Homo sapiens; identical to SEQ ID NO: 407

SEQ ID NO: 409 - protein, 702 aa, Homo sapiens; identical to SEQ ID NO: 407

SEQ ID NO: 410 - protein, 1023 aa, Homo sapiens
MFHLRTCAAKLRPLTASQTVKTFSQNRPAAARTFQQIRCYSAPVAAEPFLSGTSSNYVEEMYCAWLENPKSVHKSWDIFFRNTNAGAPPGTAYQSPLPLSRGSLAAVAHAQSLVEAQPNVDKLVEDHLAVQSLIRAYQIRGHHVAQLDPLGILDADLDSSVPADIISSTDKLGFYGLDESDLDKVFHLPTTTFIGGQESALPLREIIRRLEMAYCQHIGVEFMFINDLEQCQWIRQKFETPGIMQFTNEEKRTLLARLVRSTRFEEFLQRKWSSEKRFGLEGCEVLIPALKTIIDKSSENGVDYVIMGMPHRGRLNVLANVIRKELEQIFCQFDSKLEAADEGSGDVKYHLGMYHRRINRVTDRNITLSLVANPSHLEAADPVVMGKTKAEQFYCGDTEGKKVMSILLHGDAAFAGQGIVYETFHLSDLPSYTTHGTVHVVVNNQIGFTTDPRMARSSPYPTDVARVVNAPIFHVNSDDPEAVMYVCKVAAEWRSTFHKDVVVDLVCYRRNGHNEMDEPMFTQPLMYKQIRKQKPVLQKYAELLVSQGVVNQPEYEEEISKYDKICEEAFARSKDEKILHIKHWLDSPWPGFFTLDGQPRSMSCPSTGLTEDILTHIGNVASSVPVENFTIHGGLSRILKTRGEMVKNRTVDWALAEYMAFGSLLKEGIHIRLSGQDVERGTFSHRHHVLHDQNVDKRTCIPMNHLWPNQAPYTVCNSSLSEYGVLGFELGFAMASPNALVLWEAQFGDFHNTAQCIIDQFICPGQAKWVRQNGIVLLLPHGMEGMGPEHSSARPERFLQMCNDDPDVLPDLKEANFDINQLYDCNWVVVNCSTPGNFFHVLRRQILLPFRKPLIIFTPKSLLRHPEARSSFDEMLPGTHFQRVIPEDGPAAQNPENVKRLLFCTGKVYYDLTRERKARDMVGQVAITRIEQLSPFPFDLLLKEVQKYPNAELAWCQEEHKNQGYYDYVKPRLRTTISRAKPVWYAGRDPAAAPATGNKKTHLTELQRLLDTAFDLDVFKNFS

SEQ ID NO: 411 - protein, 1023 aa, Homo sapiens; identical to SEQ ID NO: 410

SEQ ID NO: 412 - protein, 1002 aa, Homo sapiens
MFHLRTCAAKLRPLTASQTVKTFSQNRPAAARTFQQIRCYSAPVAAEPFLSGTSSNYVEEMYCAWLENPKSVHKSWDIFFRNTNAGAPPGTAYQSPLPLSRGSLAAVAHAQSLVEAQPNVDKLVEDHLAVQSLIRAYQIRGHHVAQLDPLGILDADLDSSVPADIISSTDKLGFYGLDESDLDKVFHLPTTTFIGGQESALPLREIIRRLEMAYCQHIGVEFMFINDLEQCQWIRQKFETPGIMQFTNEEKRTLLARLVRSTRFEEFLQRKWSSEKRFGLEGCEVLIPALKTIIDKSSENGVDYVIMGMPHRGRLNVLANVIRKELEQIFCQFDSKLEAADEGSGDVKYHLGMYHRRINRVTDRNITLSLVANPSHLEAADPVVMGKTKAEQFYCGDTEGKKVMSILLHGDAAFAGQGIVYETFHLSDLPSYTTHGTVHVVVNNQIGFTTDPRMARSSPYPTDVARVVNAPIFHVNSDDPEAVMYVCKVAAEWRSTFHKDVVVDLVCYRRNGHNEMDEPMFTQPLMYKQIRKQKPVLQKYAELLVSQGVVNQPEYEEEISKYDKICEEAFARSKDEKILHIKHWLDSPWPGFFTLDGQPRSMSCPSTGLTEDILTHIGNVASSVPVENFTIHGGLSRILKTRGEMVKNRTVDWALAEYMAFGSLLKEGIHIRLSGQDVERGTFSHRHHVLHDQNVDKRTCIPMNHLWPNQAPYTVCNSSLSEYGVLGFEAGLRMASPNALVLWEAQFGDFHNTAQCIIDQFICPGQAKWVRQNGIVLLLPHGMEGMGPEHSSARPERFLQMCNDDPDVLPDLKEANFDINQLYDCNWVVVNCSTPGNFFHVLRRQILLPFRKPLIIFTPKSLLRHPEARSSFDEMLPGTHFQRVIPEDGPAAQNPENVKRLLFCTGKVYYDLTRERKARDMVGQVAITRIEQLSPFPFDLLLKEVQKYPNAELAWCQEEHKNQGYYDYVKPRLRTTISRAKPVWYAGRNPAAAPATGNKKTH

SEQ ID NO: 413 - protein, 1023 aa, Homo sapiens; identical to SEQ ID NO: 410

SEQ ID NO: 414 - protein, 1023 aa, Homo sapiens; identical to SEQ ID NO: 410

SEQ ID NO: 415 - protein, 455 aa, Homo sapiens
MTTMAAATLLRATPHFSGLAAGRTFLLQGLLRLLKAPALPLLCRGLAVEAKKTYVRDKPHVNVGTIGHVDHGKTTLTAAITKILAEGGGAKFKKYEEIDNAPEERARGITINAAHVEYSTAARHYAHTDCPGHADYVKNMITGTAPLDGCILVVAANDGPMPQTREHLLLARQIGVEHVVVYVNKADAVQDSEMVELVELEIRELLTEFGYKGEETPVIVGSALCALEGRDPELGLKSVQKLLDAVDTYIPVPARDLEKPFLLPVEAVYSVPGRGTVVTGTLERGILKKGDECELLGHSKNIRTVVTGIEMFHKSLERAEAGDNLGALVRGLKREDLRRGLVMVKPGSIKPHQKVEAQVYILSKEEGGRHKPFVSHFMPVMFSLTWDMACRIILPPEKELAMPGEDLKFNLILRQPMILEKGQRFTLRDGNRTIGTGLVTNTLAMTEEEKNIKWG

SEQ ID NO: 416 - protein, 349 aa, Homo sapiens
MTTMAAATLLRATPHFSGLAAGRTFLLQGLLRLLKAPALPLLCRGLAVEAKKTYVRDKPHVNVGTIGHVDHGKTTLTAAITKILAEGGGAKFKKYEEIDNAPEERARGITINAAHVEYSTAARHYAHTDCPGHADYVKNMITGTAPLDGCILVVAANDGPMPQTREHLLLARQIGVEHVVVYVNKADAVQDSEMVELVELEIRELLTEFGYKGEETPVIVGSALCALEGRDPELGLKSVQKLLDAVDTYIPVPARDLEKPFLLPVEAVYSVPGRGTVVTGTLERGILKKGDECELLGHSKNIRTVVTGLGSQSGEQGLAEGWPYPGRSLVPSLCLTFAFLLPAPFPFPS

SEQ ID NO: 417 - protein, 452 aa, Homo sapiens
MAAATLLRATPHFSGLAAGRTFLLQGLLRLLKAPALPLLCRGLAVEAKKTYVRDKPHVNVGTIGHVDHGKTTLTAAITKILAEGGGAKFKKYEEIDNAPEERARGITINAAHVEYSTAARHYAHTDCPGHADYVKNMITGTAPLDGCILVVAANDGPMPQTREHLLLARQIGVEHVVVYVNKADAVQDSEMVELVELEIRELLTEFGYKGEETPVIVGSALCALEGRDPELGLKSVQKLLDAVDTYIPVPARDLEKPFLLPVEAVYSVPGRGTVVTGTLERGILKKGDECELLGHSKNIRTVVTGIEMFHKSLERAEAGDNLGALVRGLKREDLRRGLVMVKPGSIKPHQKVEAQVYILSKEEGGRHKPFVSHFMPVMFSLTWDMACRIILPPEKELAMPGEDLKFNLILRQPMILEKGQRFTLRDGNRTIGTGLVTNTLAMTEEEKNIKWG

SEQ ID NO: 418 - protein, 455 aa, Homo sapiens; identical to SEQ ID NO: 415

SEQ ID NO: 419 - protein, 1635 aa, Homo sapiens [sequence omitted]

SEQ ID NO: 420 - protein, 1656 aa, Homo sapiens [sequence omitted]

SEQ ID NO: 421 - protein, 2403 aa, Homo sapiens
MGISTVILEMCLLWGQVLSTGGWIPRTTDYASLIPSEVPLDTTVAEGSPFPSELTLESTAAEGSPISLESTLESTVAEGSLIPSESTLESTVAEGSDSGLALRLVNGDGRCQGRVEILYRGSWGTVCDDSWDTNDANVVCRQLGCGWAMSAPGNAWFGQGSGPIALDDVRCSGHESYLWSCPHNGWLSHNCGHGEDAGVICSAAQPQSTLRPESWPVRISPPVPTEGSESSLALRLVNGGDRCRGRVEVLYRGSWGTVCDDYWDTNDANVVCRQLGCGWAMSAPGNAQFGQGSGPIVLDDVRCSGHESYLWSCPHNGWLTHNCGHSEDAGVICSAPLSRPTPSPDTWPTSHASTAGPESSLALRLVNGGDRCQGRVEVLYRGSWGTVCDDSWDTSDANVVCRQLGCGWATSAPGNARFGQGSGPIVLDDVRCSGYESYLWSCPHNGWLSHNCQHSEDAGVICSDTLPTITLPASTVGSESSLALRLVNGGDRCQGRVEVLYRGSWGTVCDDSWDTNDANVVCRQLGCGWAMLAPGNARFGQGSGPIVLDDVRCSGNESYLWSCPHNGWLSHNCGHSEDAGVICSGPESSLALGLVNGGDRCQGRVEVLYRGSWGTVCDDSWDTNDANVVCRQLGCGWATSAPGNARFGQGSGPIVLDDVRCSGHESYLWSCPNNGWLSHNCGHHEDAGVICSAAQSRSTPRPDTLSTITLPPSTVGSESSLTLRLVNGSDRCQGRVEVLYRGSWGTVCDDSWDTNDANVVCRQLGCGWATSAPGNARFGQGSGPIVLDDVRCSGHESYLWSCPHNGWLSHNCGHHEDAGVICSVSQSRPTPSPDTWPTSHASTAGSESSLALRLVNGGDRCQGRVEVLYRGSWGTVCDDSWDTSDANVVCRRLGCGWATSAPGNARFGQGSGPIVLDDVRCSGYESYLWSCPHNGWLSHNCQHSEDAGVICSAAHSWSTPSPDTLPTITLPASTVGSESSLALRLVNGGDRCQGRVEVLYQGSWGTVCDDSWDTNDANVVCRQLGCGWAMSAPGNARFGQGSGPIVLDDVRCSGHESYLWSCPHNGWLSHNCGHSEDAGVICSASQSRPTPSPDTWPTSHASTAGSESSLALRLVNGGDRCQGRVEVLYRGSWGTVCDDYWDTNDANVVCRQLGCGWAMSAPGNARFGQGSGPIVLDDVRCSGHESYLWSCPHDGWLSHNCGHHEDAGVICSASQSQPTPSPDTWPTSHASTAGSESSLALRLVNGGDRCQGRVEVLYRGPWGTVCDDYWDTNDANVVCRQLGCGWATSAPGNARFGQGSGPIVLDDVRCSGHESYLWSCPHNGWLSHNCGHHEDAGVICSASQSQPTPSPDTWPTSHASTAGSESSLALRLVNGGDRCQGRVEVLYRGSWGTVCDDYWDTNDANVVCRQLGCGWATSAPGSARFGQGSGPIALDDVRCSGHESYLWSCPHNGWLSHNCGHHEDAGVICSASQSQPTPSPDTWPTSRASTAGSESTLALRLVNGGDRCRGRVEVLYQGSWGTVCDDYWDTNDANVVCRQLGCGWAMSAPGNAQFGQGSGPIVLDDVRCSGHESYLWSCPHNGWLSHNCGHHEDAGVICSAAQSQSTPRPDTWLTTNLPALTVGSESSLALRLVNGGDRCRGRVEVLYRGSWGTVCDDSWDTNDANVVCRQLGCGWAMSAPGNARFGQGSGPIVLDDVRCSGNESYLWSCPHKGWLTHNCGHHEDAGVICSATQINSTTTDWWHPTTTTTARPSSNCGGFLFYASGTFSSPSYPAYYPNNAKCVWEIEVNSGYRINLGFSNLKLEAHHNCSFDYVEIFDGSLNSSLLLGKICNDTRQIFTSSYNRMTIHFRSDISFQNTGFLAWYNSFPSDATLRLVNLNSSYGLCAGRVEIYHGGTWGTVCDDSWTIQEAEVVCRQLGCGRAVSALGNAYFGSGSGPITLDDVECSGTESTLWQCRNRGWFSHNCNHREDAGVICSGNHLSTPAPFLNITRPNTDYSCGGFLSQPSGDFSSPFYPGNYPNNAKCVWDIEVQNNYRVTVIFRDVQLEGGCNYDYIEVFDGPYRSSPLIARVCDGARGSFTSSSNFMSIRFISDHSITRRGFRAEYYSSPSNDSTNLLCLPNHMQASVSRSYLQSLGFSASDLVISTWNGYYECRPQITPNLVIFTIPYSGCGTFKQADNDTIDYSNFLTAAVSGGIIKRRTDLRIHVSCRMLQNTWVDTMYIANDTIHVANNTIQVEEVQYGNFDVNISFYTSSSFLYPVTSRPYYVDLNQDLYVQAEILHSDAVLTLFVDTCVASPYSNDFTSLTYDLIRSGCVRDDTYGPYSSPSLRIARFRFRAFHFLNRFPSVYLRCKMVVCRAYDPSSRCYRGCVLRSKRDVGSYQEKVDVVLGPIQLQTPPRREEEPR

SEQ ID NO: 422 - protein, 1657 aa, Homo sapiens [sequence omitted]

SEQ ID NO: 423 - protein, 2413 aa, Homo sapiens
MGISTVILEMCLLWGQVLSTGGWIPRTTDYASLIPSEVPLDQTVAEGSPFPSESTLESTAAEGSPISLESTLESTVAEGSLIPSESTLESTVAEGSDSGLALRLVNGDGRCQGRVEILYRGSWGTVCDDSWDTNDANVVCRQLGCGWAMSAPGNAWFGQGSGPIALDDVRCSGHESYLWSCPHNGWLSHNCGHGEDAGVICSAAQPQSTLRPESWPVRISPPVPTEGSESSLALRLVNGGDRCRGRVEVLYRGSWGTVCDDYWDTNDANVVCRQLGCGWAMSAPGNAQFGQGSGPIVLDDVRCSGHESYLWSCPHNGWLTHNCGHSEDAGVICSAPQSRPTPSPDTWPTSHASTAGPESSLALRLVNGGDRCQGRVEVLYRGSWGTVCDDSWDTSDANVVCRQLGCGWATSAPGNARFGQGSGPIVLDDVRCSGYESYLWSCPHNGWLSHNCQHSEDAGVICSAAHSWSTPSPDTLPTITLPASTVGSESSLALRLVNGGDRCQGRVEVLYRGSWGTVCDDSWDTNDANVVCRQLGCGWAMLAPGNARFGQGSGPIVLDDVRCSGNESYLWSCPHNGWLSHNCGHSEDAGVICSGPESSLALRLVNGGDRCQGRVEVLYRGSWGTVCDDSWDTNDANVVCRQLGCGWAMSAPGNARFGQGSGPIVLDDVRCSGHESYLWSCPNNGWLSHNCGHHEDAGVICSAAQSRSTPRPDTLSTITLPPSTVGSESSLTLRLVNGSDRCQGRVEVLYRGSWGTVCDDSWDTNDANVVCRQLGCGWAMSAPGNARFGQGSGPIVLDDVRCSGHESYLWSCPHNGWLSHNCGHHEDAGVICSVSQSRPTPSPDTWPTSHASTAGSESSLALRLVNGGDRCQGRVEVLYRGSWGTVCDDSWDTSDANVVCRQLGCGWATSAPGNARFGQGSGPIVLDDVRCSGYESYLWSCPHNGWLSHNCQHSEDAGVICSAAHSWSTPSPDTLPTITLPASTVGSESSLALRLVNGGDRCQGRVEVLYQGSWGTVCDDSWDTNDANVVCRQPGCGWAMSAPGNARFGQGSGPIVLDDVRCSGHESYPWSCPHNGWLSHNCGHSEDAGVICSASQSRPTPSPDTWPTSHASTAGSESSLALRLVNGGDRCQGRVEVLYRGSWGTVCDDYWDTNDANVVCRQLGCGWAMSAPGNARFGQGSGPIVLDDVRCSGHESYLWSCPHNGWLSHNCGHHEDAGVICSASQSQPTPSPDTWPTSHASTAGSESSLALRLVNGGDRCQGRVEVLYRGSWGTVCDDYWDTNDANVVCRQLGCGWATSAPGNARFGQGSGPIVLDDVRCSGHESYLWSCPHNGWLSHNCGHHEDAGVICSASQSQPTPSPDTWPTSHASTAGSESSLALRLVNGGDRCQGRVEVLYRGSWGTVCDDYWDTNDANVVCRQLGCGWATSAPGNARFGQGSGPIVLDDVRCSGHESYLWSCPHNGWLSHNCGHHEDAGVICSASQSQPTPSPDTWPTSRASTAGSESTLALRLVNGGDRCRGRVEVLYQGSWGTVCDDYWDTNDANVVCRQLGCGWAMSAPGNAQFGQGSGPIVLDDVRCSGHESYLWSCPHNGWLSHNCGHHEDAGVICSAAQSQSTPRPDTWLTTNLPALTVGSESSLALRLVNGGDRCRGRVEVLYRGSWGTVCDDSWDTNDANVVCRQLGCGWAMSAPGNARFGQGSGPIVLDDVRCSGNESYLWSCPHKGWLTHNCGHHEDAGVICSATQINSTTTDWWHPTTTTTARPSSNCGGFLFYASGTFSSPSYPAYYPNNAKCVWEIEVNSGYRINLGFSNLKLEAHHNCSFDYVEIFDGSLNSSLLLGKICNDTRQIFTSSYNRMTIHFRSDISFQNTGFLAWYNSFPSDATLRLVNLNSSYGLCAGRVEIYHGGTWGTVCDDSWTIQEAEVVCRQLGCGRAVSALGNAYFGSGSGPITLDDVECSGTESTLWQCRNRGWFSHNCNHREDAGVICSGNHLSTPAPFLNITRPNTDYSCGGFLSQPSGDFSSPFYPGNYPNNAKCVWDIEVQNNYRVTVIFRDVQLEGGCNYDYIEVFDGPYRSSPLIARVCDGARGSFTSSSNFMSIRFISDHSITRRGFRAEYYSSPSNDSTNLLCLPNHMQASVSRSYLQSLGFSASDLVISTWNGYYECRPQITPNLVIFTIPYSGCGTFKQADNDTIDYSNFLTAAVSGGIIKRRTDLRIHVSCRMLQNTWVDTMYIANDTIHVANNTIQVEEVQYGNFDVNISFYTSSSFLYPVTSRPYYVDLNQDLYVQAEILHSDAVLTLFVDTCVASPYSNDFTSLTYDLIRSGCVRDDTYGPYSSPSLRIARFRFRAFHFLNRFPSVYLRCKMVVCRAYDPSSRCYRGCVLRSKRDVGSYQEKVDVVLGPIQLQTPPRREEEPR

SEQ ID NO: 424 - protein, 1049 aa, Homo sapiens [sequence omitted]

SEQ ID NO: 425 - protein, 1110 aa, Homo sapiens
MGKNRMVLLGGAGSPGYKGFVHLGFFVVAVSSLLSVSAVTQAPEGRKKELRLAGGENNCSGRVELKIHEKWGTVCGNGWSMNEVSVVCQQLGCPTLIKAPGWANASAGSGDIWMDKVSCTGNESALWDCKHEGWGKHNCTHEQDAGVTCADGSNLEMRLVNSGDNRCSGRVEIKFQGKWGTVCDDNFSKDHASVICKQLGCGSAISFSGSAKLGAGSGQIWLDDLACNGNESAIWDCKHRGWGRHNCDHAEDVGVICLDGADLSLRLVDGVSKCSGRLEVRFQGEWGTVCDDSWDRRDASVVCKQLGCPTAITAIGRVNASEGSGPIWLDSISCEGHEPALWECKHQEWGKHYCNHKEDAGVTCSDGADLELRLVGGGSRCAGMVEVEIQKLTGKVCSRGWTLTDADVVCRQLGCGSALQTQSKIYSKTKTEATNTWLFPGSCSGNETSLWQCKNWQWGGLSCDHFEEAQVTCSGHRKPRLVGGEIPCSGRVEVKHGDTWGSVCDFDLSLEAAGVVCRELQCGTVVSILGGAHFGEGSGQIWGEEFQCSGDESHLSLCSVAPPLDRTCSHSRDVSIVCSRYIDIRLADGKSSCEGRVELKTLGAWGPLCSSHWDIEDAHVLCQQLKCGVALSTPGGAHFGKGAGQVWRHKFHCTGTEEHIGDCPMTALGTPMCSDGQVASVICSGNQSHTLLPCSSSSSVQTTSSTIAKDSDVPCIASGQLRLVGGGGRCAGRVEVYHEGSWGTICDDSWDLTDANVVCKQLDCGVAINATGSAYFGEGTGDIWLDEIDCSGKESHIWQCHSHGWGRHNCRHKEDAGVVCSEFMSLRLTNEAHRVNCTGRLEVFYNGTWGSIGSSNMSPTTVGVVCRQLGCADNGTVKPTSSDKTPTRPMWTDSVQCPKGVDTLWQCPSSPWKQRQASPSQESWIVCDDKIRLQEGHTDCSGRVEIWHRGSWGTVCDDSWDLNDAEVACKQLGCGQAVEALKEAAFGPGTGPIWLNEMKCRGNESSLWDCPARPWSHSDCGHKEDASVKCLPRMTLESQHGTGHSTLTALLVCGAILLVLLIAFLLWTLKRRQTQRLTVSSRGEVLIHQVQYQEMDSKTDDLDLLKSSGQ

SEQ ID NO: 426 - protein, 266 aa, Homo sapiens
MVCLKLPGGSCMTALTVTLMVLSSPLALAGDTRPRFLWQLKFECHFFNGTERVRLLERCIYNQEESVRFDSDVGEYRAVTELGRPDAEYWNSQKDLLEQRRAAVDTYCRHNYGVGESFTVQRRVEPKVTVYPSKTQPLQHHNLLVCSVSGFYPGSIEVRWFRNGQEEKAGVVSTGLIQNGDWTFQTLVMLETVPRSGEVYTCQVEHPSVTSPLTVEWRARSESAQSKMLSGVGGFVLGLLFLGAGLFIYFRNQKGHSGLQPTGFLS

SEQ ID NO: 427 - protein, 198 aa, Homo sapiens
GDTRPRFLWQPKRECHFFNGTERVRFLDRYFYNQEESVRFDSDVGEFRAVTELGRPDAEYWNSQKDILEQARAAVDTYCRHNYGVVESFTVQRRVQPKVTVYPSKTQPLQHHNLLVCSVSGFYPGSIEVRWFLNGQEEKAGGVSTGLIQDDWTFQTLVMLETVPRSGEVYTCQVEHPSVTSPLTVEWRARSESAQSKM

SEQ ID NO: 428 - protein, 266 aa, Homo sapiens [sequence omitted]

SEQ ID NO: 429 - protein, 266 aa, Homo sapiens [sequence omitted]

SEQ ID NO: 430 - protein, 266 aa, Homo sapiens [sequence omitted]

SEQ ID NO: 431 - protein, 266 aa, Homo sapiens [sequence omitted]

SEQ ID NO: 432 - protein, 266 aa, Homo sapiens [sequence omitted]

SEQ ID NO: 433 - protein, 181 aa, Homo sapiens
PARFLEQVKHECHFFNGTERVRFLDRYFYHQEEYVRFDSDVGEYRAVTELGRPDAEYWNSQKDLLEQKRAAVDTYCRHNYGVGESFTVQRRVYPEVTVYPAKTQPLQHHNLLVCSVNGFYPGSIEVRWFRNGQEEKTGVVSTGLIQNGDWTFQTLVMLETVPRSGEVYTCQVEHPSLTSPL

SEQ ID NO: 434 - protein, 266 aa, Homo sapiens [sequence omitted]

SEQ ID NO: 435 - protein, 266 aa, Homo sapiens
MVCLKLPGGSYMAKLTVTLMVLSSPLALAGDTRPRFLQQDKYECHFFNGTERVRFLHRDIYNQEEDLRFDSDVGEYRAVTELGRPDAEYWNSQKDFLEDRRAAVDTYCRHNYGVGESFTVQRRVEPKVTVYPARTQTLQHHNLLVCSVNGFYPGSIEVRWFRNSQEEKAGVVSTGLIQNGDWTFQTLVMLETVPRSGEVYTCQVEHPSVTSPLTVEWRAQSESAQSKMLSGVGGFVLGLLFLGAGLFIYFKNQKGHSGLHPTGLVS

SEQ ID NO: 436 - protein, 170 aa, Homo sapiens
PARFLEQVKHECHFFNGTERVRFLDRYFYHQEEYVRFDSDVGEYRAVTELGRPDAEYWNSQKDLLEQKRAAVDTYCRHNYGVGESFTVQRRVYPEVTVYPAKTQPLQHHNLLVCSVNGFYPGSIEVRWFRNGQEEKTGVVSTGLIQNGEVPRSGEVYTCQVEHPSLTSPL

SEQ ID NO: 437 - protein, 906 aa, Homo sapiens
MTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQGDLMKAAAGEFADDPCSSVKRGNMVRAARALLSAVTRLLILADMADVYKLLVQLKVVEDGILKLRNAGNEQDLGIQYKALKPEVDKLNIMAAKRQQELKDVGHRDQMAAARGILQKNVPILYTASQACLQHPDVAAYKANRDLIYKQLQQAVTGISNAAQATASDDASQHQGGGGGELAYALNNFDKQIIVDPLSFSEERFRPSLEERLESIISGAALMADSSCTRDDRRERIVAECNAVRQALQDLLSEYMGNAGRKERSDALNSAIDKMTKKTRDLRRQLRKAVMDHVSDSFLETNVPLLVLIEAAKNGNEKEVKEYAQVFREHANKLIEVANLACSISNNEEGVKLVRMSASQLEALCPQVINAALALAAKPQSKLAQENMDLFKEQWEKQVRVLTDAVDDITSIDDFLAVSENHILEDVNKCVIALQEKDVDGLDRTAGAIRGRAARVIHVVTSEMDNYEPGVYTEKVLEATKLLSNTVMPRFTEQVEAAVEALSSDPAQPMDENEFIDASRLVYDGIRDIRKAVLMIRTPEELDDSDFETEDFDVRSRTSVQTEDDQLIAGQSARAIMAQLPQEQKAKIAEQVASFQEEKSKLDAEVSKWDDSGNDIIVLAKQMCMIMMEMTDFTRGKGPLKNTSDVISAAKKIAEAGSRMDKLGRTIADHCPDSACKQDLLAYLQRIALYCHQLNICSKVKAEVQNLGGELVVSGVDSAMSLIQAAKNLMNAVVQTVKASYVASTKYQKSQGMASLNLPAVSWKMKAPEKKPLVKREKQDETQTKIKRASQKKHVNPVQALSEFKAMDSI

SEQ ID NO: 438 - protein, 536 aa, Homo sapiens
MTKKTRDLRRQLRKAVMDHVSDSFLETNVPLLVLIEAAKNGNEKEVKEYAQVFREHANKLIEVANLACSISNNEEGVKLVRMSASQLEALCPQVINAALALAAKPQSKLAQENMDLFKEQWEKQVRVLTDAVDDITSIDDFLAVSENHILEDVNKCVIALQEKDVDGLDRTAGAIRGRAARVIHVVTSEMDNYEPGVYTEKVLEATKLLSNTVMPRFTEQVEAAVEALSSDPAQPMDENEFIDASRLVYDGIRDIRKAVLMIRTPEELDDSDFETEDFDVRSRTSVQTEDDQLIAGQSARAIMAQLPQEQKAKIAEQVASFQEEKSKLDAEVSKWDDSGNDIIVLAKQMCMIMMEMTDFTRGKGPLKNTSDVISAAKKIAEAGSRMDKLGRTIADHCPDSACKQDLLAYLQRIALYCHQLNICSKVKAEVQNLGGELVVSGVDSAMSLIQAAKNLMNAVVQTVKASYVASTKYQKSQGMASLNLPAVSWKMKAPEKKPLVKREKQDETQTKIKRASQKKHVNPVQALSEFKAMDSI

SEQ ID NO: 439 - protein, 906 aa, Homo sapiens; identical to SEQ ID NO: 437

SEQ ID NO: 440 - protein, 841 aa, Homo sapiens
MTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQGDLMKAAAGEFADDPCSSVKRGNMVRAARALLSAVTRLLILADMADVYKLLVQLKVVEDGILKLRNAGNEQDLGIQYKALKPEVDKLNIMAAKRQQELKDVGHRDQMAAARGILQKNVPILYTASQACLQHPDVAAYKANRDLIYKQLQQAVTGISNAAQATASDDASQHQGGGGGELAYALNNFDKQIIVDPLSFSEERFRPSLEERLESIISGAALMADSSCTRDDRRERIVAECNAVRQALQDLLSEYMGNAGRKERSDALNSAIDKMTKKTRDLRRQLRKAVMDHVSDSFLETNVPLLVLIEAAKNGNEKEVKEYAQVFREHANKLIEVANLACSISNNEEGVKLVRMSASQLEALCPQVINAALALAAKPQSKLAQENMDLFKEQWEKQVRVLTDAVDDITSIDDFLAVSENHILEDVNKCVIALQEKDVDGLDRTAGAIRGRAARVIHVVTSEMDNYEPGVYTEKVLEATKLLSNTVMPRFTEQVEAAVEALSSDPAQPMDENEFIDASRLVYDGIRDIRKAVLMIRTPEELDDSDFETEDFDVRSRTSVQTEDDQLIAGQSARAIMAQLPQEQKAKIAEQVASFQEEKSKLDAEVSKWDDSGNDIIVLAKQMCMIMMEMTDFTRGKGPLKNTSDVISAAKKIAEAGSRMDKLGRTIADHCPDSACKQDLLAYLQRIALYCHQLNICSKVKAEVQNLGGELVVSGNCDTCGALQGLKGWPPPLCWPLTGWTAPCP

SEQ ID NO: 441 - protein, 375 aa, Homo sapiens
MSASAPAAEGEGTPTQPASEKEPEMPGPREESEEEEDEDDEEEEEEEKEKSLIVEGKREKKKVERLTMQVSSLQREPFTIAQGKGQKLCEIERIHFFLSKKKTDELRNLHKLLYNRPGTVSSLKKNVGQFSGFPFEKGSVQYKKKEEMLKKFRNAMLKSICEVLDLERSGVNSELVKRILNFLMHPKPSGKPLPKSKKTCSKGSKKERNSSGMARKAKRTKCPEILSDESSSDEDEKKNKEESSDDEDKESEEEPPKKTAKREKPKQKATSKSKKSVKSANVKKADSSTTKKNQNSSKKESESEDSSDDEPLIKKLKKPPTDEELKETIKKLLASANLEEVTMKQICKKVYENYPTYDLTERKDFIKTTVKELIS

SEQ ID NO: 442 - protein, 380 aa, Homo sapiens
MSASAPAAEGEGTPTQPASEKEPEMPGPREESEEEEDEDDEEEEEEEKEKSLIVEGKREKKKVERLTMQVSSLQREPFTIAQGKGQKLCEIERIHFFLSKKKTDELRNLHKLLYNRPGTVSSLKKNVGQFSGFPFEKGSVQYKKKEEMLKKFRNAMLKSICEVLDLERSGVNSELVKRILNFLMHPKPSGKPLPKSKKTCSKGSKKERNSSGMARKAKRTKCPEILSDESSSDEDEKKNKEESSDDEDKESEEEPPKKTAKREKPKQKATSKSKKSVKSANVKKADSSTTKKNQNSSKKESESEDSSDDEPLIKKLKKPPTDEELKETIKKLLASANLEEVTMKQICKKVYENYPTYDLTERKDFIKTTVKEVNISVFQV

SEQ ID NO: 443 - protein, 375 aa, Homo sapiens; identical to SEQ ID NO: 441

SEQ ID NO: 444 - protein, 375 aa, Homo sapiens; identical to SEQ ID NO: 441

SEQ ID NO: 445 - protein, 677 aa, Homo sapiens
MGVPFFSSLRCMVDLGPCWAGGLTAEMKLLLALAGLLAILATPQPSEGAAPAVLGEVDTSLVLSSMEEAKQLVDKAYKERRESIKQRLRSGSASPMELLSYFKQPVAATRTAVRAADYLHVALDLLERKLRSLWRRPFNVTDVLTPAQLNVLSKSSGCAYQDVGVTCPEQDKYRTITGMCNNRRSPTLGASNRAFVRWLPAEYEDGFSLPYGWTPGVKRNGFPVALARAVSNEIVRFPTDQLTPDQERSLMFMQWGQLLDHDLDFTPEPAARASFVTGVNCETSCVQQPPCFPLKIPPNDPRIKNQADCIPFFRSCPACPGSNITIRNQINALTSFVDASMVYGSEEPLARNLRNMSNQLGLLAVNQRFQDNGRALLPFDNLHDDPCLLTNRSARIPCFLAGDTRSSEMPELTSMHTLLLREHNRLATELKSLNPRWDGERLYQEARKIVGAMVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDR

SEQ ID NO: 446 - protein, 715 aa, Homo sapiens
MHLLPALAGVLATLVLAQPCEGTDPASPGAVETSVLRDCIAEAKLLVDAAYNWTQKSIKQRLRSGSASPMDLLSYFKQPVAATRTVVRAADYMHVALGLLEEKLQPQRSGPFNVTDVLTEPQLRLLSQASGCALRDQAERCSDKYRTITGRCNNKRRPLLGASNQALARWLPAEYEDGLSLPFGWTPSRRRNGFLLPLVRAVSNQIVRFPNERLTSDRGRALMFMQWGQFIDHDLDFSPESPARVAFTAGVDCERTCAQLPPCFPIKIPPNDPRIKNQRDCIPFFRSAPSCPQNKNRVRNQINALTSFVDASMVYGSEVSLSLRLRNRTNYLGLLAINQRFQDNGRALLPFDNLHDDPCLLTNRSARIPCFLAGDTRSTETPKLAAMHTLFMREHNRLATELRRLNPRWNGDKLYNEARKIMGAMVQIITYRDFLPLVLGKARARRTLGHYRGYCSNVDPRVANVFTLAFRFGHTMLQPFMFRLDSQYRASAPNSHVPLSSAFFASWRIVYEGGIDPILRGLMATPAKLNRQDAMLVDELRDRLFRQVRRIGLDLAALNMQRSRDHGLPGYNAWRRFCGLSQPRNLAQLSRVLKNQDLARKFLNLYGTPDNIDIWIGAIAEPLLPGARVGPLLACLFENQFRRARDGDRFWWQKRGVFTKRQRKALSRISLSRIICDNTGITTVSRDIFRANIYPRGFVNCSRIPRLNLSAWRGT

SEQ ID NO: 447 - protein, 715 aa, Homo sapiens; identical to SEQ ID NO: 446

SEQ ID NO: 448 - protein, 659 aa, Homo sapiens
MHLLPALAGVLATLVLAQPCEGTDPASPGAVETSVLRDCIAEAKLLVDAAYNWTQKSIKQRLRSGSASPMDLLSYFKQPVAATRTVVRAADYMHVALGLLEEKLQPQRSGPFNVTDVLTEPQLRLLSQASGCALRDQAERCSDKYRTITGRCNNKRRPLLGASNQALARWLPAEYEDGLSLPFGWTPSRRRNGFLLPLVRAVSNQIVRFPNERLTSDRGRALMFMQWGQFIDHDLDFSPESPARVAFTAGVDCERTCAQLPPCFPIKIPPNDPRIKNQRDCIPFFRSAPSCPQNKNRVRNQINALTSFVDASMVYGSEVSLSLRLRNRTNYLGLLAINQRFQDNGRALLPFDNLHDDPCLLTNRSARIPCFLAGDTRSTETPKLAAMHTLFMREHNRLATELRRLNPRWNGDKLYNEARKIMGAMVQIITYRDFLPLVLGKARARRTLGHYRGYCSNVDPRVANVFTLAFRFGHTMLQPFMFRLDSQYRASAPNSHVPLSSAFFASWRIVYEGDQVFQGANGGGIDPILRGLMATPAKLNRQDAMLVDELRDRLFRQVRRIGLDLAALNMQRSRDHGLPGYNAWRRFCGLSQPRNLAQLSRVLKNQDLARKFLNLYGTPDNIDIWIGAIAEPLLPGARVGPLLACLFENQFRRARDGDR

SEQ ID NO: 449 - protein, 715 aa, Homo sapiens; identical to SEQ ID NO: 446

SEQ ID NO: 450 - protein, 255 aa, Homo sapiens
MAAAEAANCIMEVSCGQAESSEKPNAEDMTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKEVDIYTVKVEDLTFTSPFCLQVKRNDYVHALVAYFNIEFTRCHKRTGFSTSPESPYTHWKQTVFYMEDYLTVKTGEEIFGTIGMRPNAKNNRDLDFTIDLDFKGQLCELSCSTDYRMR

SEQ ID NO: 451 - protein, 856 aa, Homo sapiens
MALVLGSLLLLGLCGNSFSGGQPSSTDAPKAWNYELPATNYETQDSHKAGPIGILFELVHIFLYVVQPRDFPEDTLRKFLQKAYESKIDYDKIVYYEAGIILCCVLGLLFIILMPLVGYFFCMCRCCNKCGGEMHQRQKENGPFLRKCFAISLLVICIIISIGIFYGFVANHQVRTRIKRSRKLADSNFKDLRTLLNETPEQIKYILAQYNTTKDKAFTDLNSINSVLGGGILDRLRPNIIPVLDEIKSMATAIKETKEALENMNSTLKSLHQQSTQLSSSLTSVKTSLRSSLNDPLCLVHPSSETCNSIRLSLSQLNSNPELRQLPPVDAELDNVNNVLRTDLDGLVQQGYQSLNDIPDRVQRQTTTVVAGIKRVLNSIGSDIDNVTQRLPIQDILSAFSVYVNNTESYIHRNLPTLEEYDSYWWLGGLVICSLLTLIVIFYYLGLLCGVCGYDRHATPTTRGCVSNTGGVFLMVGVGLSFLFCWILMIIVVLTFVFGANVEKLICEPYTSKELFRVLDTPYLLNEDWEYYLSGKLFNKSKMKLTFEQVYSDCKKNRGTYGTLHLQNSFNISEHLNINEHTGSISSELESLKVNLNIFLLGAAGRKNLQDFAACGIDRMNYDSYLAQTGKSPAGVNLLSFAYDLEAKANSLPPGNLRNSLKRDAQTIKTIHQQRVLPIEQSLSTLYQSVKILQRTGNGLLERVTRILASLDFAQNFITNNTSSVIIEETKKYGRTIIGYFEHYLQWIEFSISEKVASCKPVATALDTAVDVFLCSYIIDPLNLFWFGIGKATVFLLPALIFAVKLAKYYRRMDSEDVYDDVETIPMKNMENGNNGYHKDHVYGIHNPVMTSPSQH

SEQ ID NO: 452 - protein, 865 aa, Homo sapiens
MALVLGSLLLLGLCGNSFSGGQPSSTDAPKAWNYELPATNYETQDSHKAGPIGILFELVHIFLYVVQPRDFPEDTLRKFLQKAYESKIDYDKPETVILGLKIVYYEAGIILCCVLGLLFIILMPLVGYFFCMCRCCNKCGGEMHQRQKENGPFLRKCFAISLLVICIIISIGIFYGFVANHQVRTRIKRSRKLADSNFKDLRTLLNETPEQIKYILAQYNTTKDKAFTDLNSINSVLGGGILDRLRPNIIPVLDEIKSMATAIKETKEALENMNSTLKSLHQQSTQLSSSLTSVKTSLRSSLNDPLCLVHPSSETCNSIRLSLSQLNSNPELRQLPPVDAELDNVNNVLRTDLDGLVQQGYQSLNDIPDRVQRQTTTVVAGIKRVLNSIGSDIDNVTQRLPIQDILSAFSVYVNNTESYIHRNLPTLEEYDSYWWLGGLVICSLLTLIVIFYYLGLLCGVCGYDRHATPTTRGCVSNTGGVFLMVGVGLSFLFCWILMIIVVLTFVFGANVEKLICEPYTSKELFRVLDTPYLLNEDWEYYLSGKLFNKSKMKLTFEQVYSDCKKNRGTYGTLHLQNSFNISEHLNINEHTGSISSELESLKVNLNIFLLGAAGRKNLQDFAACGIDRMNYDSYLAQTGKSPAGVNLLSFAYDLEAKANSLPPGNLRNSLKRDAQTIKTIHQQRVLPIEQSLSTLYQSVKILQRTGNGLLERVTRILASLDFAQNFITNNTSSVIIEETKKYGRTIIGYFEHYLQWIEFSISEKVASCKPVATALDTAVDVFLCSYIIDPLNLFWFGIGKATVFLLPALIFAVKLAKYYRRMDSEDVYDDVETIPMKNMENGNNGYHKDHVYGIHNPVMTSPSQH

SEQ ID NO: 453 - protein, 865 aa, Homo sapiens; identical to SEQ ID NO: 452

SEQ ID NO: 454 - protein, 865 aa, Homo sapiens; identical to SEQ ID NO: 452

SEQ ID NO: 455 - protein, 309 aa, Homo sapiens [sequence omitted]

SEQ ID NO: 456 - protein, 271 aa, Homo sapiens [sequence omitted]

SEQ ID NO: 457 - protein, 271 aa, Homo sapiens
MPEAPPLLLAAVLLGLVLLVVLLLLLRHWGWGLCLIGWNEFILQPIHNLLMGDTKEQRILNHVLQHAEPGNAQSVLEAIDTYCEQKEWAMNVGDKKGKIVDAVIQEHQPSVLLELGAYCGYSAVRMARLLSPGARLITIEINPDCAAITQRMVDFAGVKDKVTLVVGASQDIIPQLKKKYDVDTLDMVFLDHWKDRYLPDTLLLEECGLLRKGTVLLADNVICPGAPDFLAHVRGSSCFECTHYQSFLEYREVVDGLEKAIYKGPGSEAGP

SEQ ID NO: 458 - protein, 271 aa, Homo sapiens [sequence omitted]

SEQ ID NO: 459 - protein, 221 aa, Homo sapiens
MGDTKEQRILNHVLQHAEPGNAQSVLEAIDTYCEQKEWAMNVGDKKGKIVDAVIQEHQPSVLLELGAYCGYSAVRMARLLSPGARLITIEINPDCAAITQRMVDFAGVKDKVTLVVGASQDIIPQLKKKYDVDTLDMVFLDHWKDRYLPDTLLLEECGLLRKGTVLLADNVICPGAPDFLAHVRGSSCFECTHYQSFLEYREVVDGLEKAIYKGPGSEAGP

SEQ ID NO: 460 - protein, 1548 aa, Homo sapiens [sequence omitted]

SEQ ID NO: 461 - protein, 660 aa, Homo sapiens [sequence omitted]

SEQ ID NO: 462 - protein, 660 aa, Homo sapiens
MDVLVSECSARLLQQEEEIKSLTAEIDRLKNCGCLGASPNLEQLQEENLKLKYRLNILRKSLQAERNKPTKNMINIISRLQEVFGHAIKAAYPDLENPPLLVTPSQQAKFGDYQCNSAMGISQMLKTKEQKVNPREIAENITKHLPDNECIEKVEIAGPGFINVHLRKDFVSEQLTSLLVNGVQLPALGENKKVIVDFSSPNIAKEMHVGHLRSTIIGESISRLFEFAGYDVLRLNHVGDWGTQFGMLIAHLQDKFPDYLTVSPPIGDLQVFYKESKKRFDTEEEFKKRAYQCVVLLQGKNPDITKAWKLICDVSRQELNKIYDALDVSLIERGESFYQDRMNDIVKEFEDRGFVQVDDGRKIVFVPGCSIPLTIVKSDGGYTYDTSDLAAIKQRLFEEKADMIIYVVDNGQSVHFQTIFAAAQMIGWYDPKVTRVFHAGFGVVLGEDKKKFKTRSGETVRLMDLLGEGLKRSMDKLKEKERDKVLTAEELNAAQTSVAYGCIKYADLSHNRLNDYIFSFDKMLDDRGNTAAYLLYAFTRIRSIARLANIDEEMLQKAARETKILLDHEKEWKLGRCILRFPEILQKILDDLFLHTLCDYIYELATAFTEFYDSCYCVEKDRQTGKILKVNMWRMLLCEAVAAVMAKGFDILGIKPVQRM

SEQ ID NO: 463 - protein, 890 aa, Homo sapiens [sequence omitted]

SEQ ID NO: 464 - protein, 890 aa, Homo sapiens [sequence omitted]

SEQ ID NO: 465 - protein, 890 aa, Homo sapiens [sequence omitted]

SEQ ID NO: 466 - protein, 890 aa, Homo sapiens
MDSNTAPLGPSCPQPPPAPQPQARSRLNATASLEQERSERPRAPGPQAGPGPGVRDAAAPAEPQAQHTRSRERADGTGPTKGDMEIPFEEVLERAKAGDPKAQTEVGKHYLQLAGDTDEELNSCTAVDWLVLAAKQGRREAVKLLRRCLADRRGITSENEREVRQLSSETDLERAVRKAALVMYWKLNPKKKKQVAVAELLENVGQVNEHDGGAQPGPVPKSLQKQRRMLERLVSSESKNYIALDDFVEITKKYAKGVIPSSLFLQDDEDDDELAGKSPEDLPLRLKVVKYPLHAIMEIKEYLIDMASRAGMHWLSTIIPTHHINALIFFFIISNLTIDFFAFFIPLVIFYLSFISMVICTLKVFQDSKAWENFRTLTDLLLRFEPNLDVEQAEVNFGWNHLEPYAHFLLSVFFVIFSFPIASKDCIPCSELAVITGFFTVTSYLSLSTHAEPYTRRALATEVTAGLLSLLPSMPLNWPYLKVLGQTFITVPVGHLVVLNVSVPCLLYVYLLYLFFRMAQLRNFKGTYCYLVPYLVCFMWCELSVVILLESTGLGLLRASIGYFLFLFALPILVAGLALVGVLQFARWFTSLELTKIAVTVAVCSVPLLLRWWTKASFSVVGMVKSLTRSSMVKLILVWLTAIVLFCWFYVYRSEGMKVYNSTLTWQQYGALCGPRAWKETNMARTQILCSHLEGHRVTWTGRFKYVRVTDIDNSAESAINMLPFFIGDWMRCLYGEAYPACSPGNTSTAEEELCRLKLLAKHPCHIKKFDRYKFEITVGMPFSSGADGSRSREEDDVTKDIVLRASSEFKSVLLSLRQGSLIEFSTILEGRLGSKWPVFELKAISCLNCMAQLSPTRRHVKIEHDWRSTVHGAVKFAFDFFFFPFLSAA

SEQ ID NO: 467 - protein, 427 aa, Homo sapiens
MFFTCGPNEAMVVSGFCRSPPVMVAGGRVFVLPCIQQIQRISLNTLTLNVKSEKVYTRHGVPISVTGIAQVKIQGQNKEMLAAACQMFLGKTEAEIAHIALETLEGHQRAIMAHMTVEEIYKDRQKFSEQVFKVASSDLVNMGISVVSYTLKDIHDDQDYLHSLGKARTAQVQKDARIGEAEAKRDAGIREAKAKQEKVSAQYLSEIEMAKAQRDYELKKAAYDIEVNTRRAQADLAYQLQVAKTKQQIEEQRVQVQVVERAQQVAVQEQEIARREKELEARVRKPAEAERYKLERLAEAEKSQLIMQAEAEAASVRMRGEAEAFAIGARARAEAEQMAKKAEAFQLYQEAAQLDMLLEKLPQVAEEISGPLTSANKITLVSSGSGTMGAAKVTGEVLDILTRLPESVERLTGVSISQVNHKPLRTA

SEQ ID NO: 468 - protein, 429 aa, Homo sapiens
MFFTCGPNEAMVVSGFCRSPPVMVAGGRVFVLPCIQQIQRISLNTLTLNVKSEKVYTRHGVPISVTGIAQVKIQGQNKEMLAAACQMFLGKTEAEIAHIALETLEGHQRAIMAHMTVEEIYKDRQKFSEQVFKVASSDLVNMGISVVSYTLKDIHDDQDYLHSLGKARTAQVQKDARIGEAEAKRDAGIREAKAKQEKVSAQYLSEIEMAKAQRDYELKKAAYDIEVNTRRAQADLAYQLQVAKTKQQIEEQRVQVQVVERAQQVAVQEQEIARREKELEARVRKPAEAERYKLERLAEAEKSQLIMQAEAEAASVRMRGEAEAFAIGARARAEAEQMAKKAEAFQLYQEAAQLDMLLEKLPQVAEEISGPLTSANKITLVSSGSGTMGAAKVTGEVLDILTRLPESVERLTGVSISQVRSQVGAEENC

SEQ ID NO: 469 - protein, 427 aa, Homo sapiens; identical to SEQ ID NO: 467

SEQ ID NO: 470 - protein, 427 aa, Homo sapiens; identical to SEQ ID NO: 467

SEQ ID NO: 471 - protein, 208 aa, Homo sapiens
MLGLLVALLALGLAVFALLDVWYLVRLPCAVLRARLLQPRVRDLLAEQRFPGRVLPSDLDLLLHMNNARYLREADFARVAHLTRCGVLGALRELRAHTVLAASCARHRRSLRLLEPFEVRTRLLGWDDRAFYLEARFVSLRDGFVCALLRFRQHLLGTSPERVVQHLCQRRVEPPELPADLQHWISYNEASSQLLRMESGLSDVTKDQ

SEQ ID NO: 472 - protein, 230 aa, Homo sapiens
PAPRTPAPAPRTPQDPAPAAAAMLGLLVALLALGLAVFALLDVWYLVRLPCAVLRARLLQPRVRDLLAEQRFPGRVLPSDLDLLLHMNNARYLREADFARVAHLTRCGVLGALRELRAHTVLAASCARHRRSLRLLEPFEVRTRLLGWDDRAFYLEARFVSLRDGFVCALLRFRQHLLGTSPERVVQHLCQRRVEPPELPADLQHWISYNEASSQLLRMESGLSDVTKDQ

SEQ ID NO: 473 - protein, 277 aa, Homo sapiens
MFPFYSCWRTGLLLLLLAVAVRESWQTEEKTCDLVGEKGKESEKELALVKRLKPLFNKSFESTVGQGSDTYIYIFRVCREAGNHTSGAGLVQINKSNGKETVVGRLNETHIFNGSNWIMLIYKGGDEYDNHCGKEQRRAVVMISCNRHTLADNFNPVSEERGKVQDCFYLFEMDSSLACSPEISHLSVGSILLVTFASLVAVYVVGGFLYQRLVVGAKGMEQFPHLAFWQDLGNLVADGCDFVCRSKPRNVPAAYRGVGDDQLGEESEERDDHLLPM

SEQ ID NO: 474 - protein, 194 aa, Homo sapiens
MLIYKGGDEYDNHCGKEQRRAVVMISCNRHTLADNFNPVSEERGKVQDCFYLFEMDSSLACSPEISHLSVGSILLVTFASLVAVYVVGGFLYQRLVVGAKGMEQFPHLAFWQDLGNLVAACGFDLFFNLLERERKQKWDIEGSAVLCAGCGMLLHLSLLLAQGSVFLPTFLWGKVFNPLMLPSSCLGHVPRNLD

SEQ ID NO: 475 - protein, 277 aa, Homo sapiens; identical to SEQ ID NO: 473

SEQ ID NO: 476 - protein, 277 aa, Homo sapiens; identical to SEQ ID NO: 473

SEQ ID NO: 477 - protein, 277 aa, Homo sapiens; identical to SEQ ID NO: 473

SEQ ID NO: 478 - protein, 701 aa, Homo sapiens
MRDSGSKAATDAQDANQCCTSCEDNAPATSYCVECSEPLCETCVEAHQRVKYTKDHTVRSTGPAKSRDGERTVYCNVHKHEPLVLFCESCDTLTCRDCQLNAHKDHQYQFLEDAVRNQRKLLASLVKRLGDKHATLQKSTKEVRSSIRQVSDVQKRVQVDVKMAILQIMKELNKRGRVLVNDAQKVTEGQQERLERQHWTMTKIQKHQEHILRFASWALESDNNTALLLSKKLIYFQLHRALKMIVDPVEPHGEMKFQWDLNAWTKSAEAFGKIVAERPGTNSTGPAPMAPPRAPGPLSKQGSGSSQPMEVQEGYGFGSGDDPYSSAEPHVSGVKRSRSGEGEVSGLMRKVPRVSLERLDLDLTADSQPPVFKVFPGSTTEDYNLIVIERGAAAAATGQPGTAPAGTPGAPPLAGMAIVKEEETEAAIGAPPTATEGPETKPVLMALAEGPGAEGPRLASPSGSTSSGLEVVAPEGTSAPGGGPGTLDDSATICRVCQKPGDLVMCNQCEFCFHLDCHLPALQDVPGEEWSCSLCHVLPDLKEEDGSLSLDGADSTGVVAKLSPANQRKCERVLLALFCHEPCRPLHQLATDSTFSLDQPGGTLDLTLIRARLQEKLSPPYSSPQEFAQDVGRMFKQFNKLTEDKADVQSIIGLQRFFETRMNEAFGDTKFSAVLVEPPPMSLPGAGLSSQELSGGPGDGP

SEQ ID NO: 479 - protein, 753 aa, Homo sapiens
MAASAAAASAAAASAASGSPGPGEGSAGGEKRSTAPSAAASASASAAASSPAGGGAEALELLEHCGVCRERLRPEREPRLLPCLHSACSACLGPAAPAAANSSGDGGAAGDGTGPAKSRDGERTVYCNVHKHEPLVLFCESCDTLTCRDCQLNAHKDHQYQFLEDAVRNQRKLLASLVKRLGDKHATLQKSTKEVRSSIRQVSDVQKRVQVDVKMAILQIMKELNKRGRVLVNDAQKVTEGQQERLERQHWTMTKIQKHQEHILRFASWALESDNNTALLLSKKLIYFQLHRALKMIVDPVEPHGEMKFQWDLNAWTKSAEAFGKIVAERPGTNSTGPAPMAPPRAPGPLSKQGSGSSQPMEVQEGYGFGSGDDPYSSAEPHVSGVKRSRSGEGEVSGLMRKVPRVSLERLDLDLTADSQPPVFKVFPGSTTEDYNLIVIERGAAAAATGQPGTAPAGTPGAPPLAGMAIVKEEETEAAIGAPPTATEGPETKPVLMALAEGPGAEGPRLASPSGSTSSGLEVVAPEGTSAPGGGPGTLDDSATICRVCQKPGDLVMCNQCEFCFHLDCHLPALQDVPGEEWSCSLCHVLPDLKEEDGSLSLDGADSTGVVAKLSPANQRKCERVLLALFCHEPCRPLHQLATDSTFSLDQPGGTLDLTLIRARLQEKLSPPYSSPQEFAQDVGRMFKQFNKLTEDKADVQSIIGLQRFFETRMNEAFGDTKFSAVLVEPPPMSLPGAGLSSQELSGGPGDGP

SEQ ID NO: 480 - protein, 835 aa, Homo sapiens
MAASAAAASAAAASAASGSPGPGEGSAGGEKRSTAPSAAASASASAAASSPAGGGAEALELLEHCGVCRERLRPEREPRLLPCLHSACSACLGPAAPAAANSSGDGGAAGDGTVVDCPVCKQQCFSKDIVENYFMRDSGSKAATDAQDANQCCTSCEDNAPATSYCVECSEPLCETCVEAHQRVKYTKDHTVRSTGPAKSRDGERTVYCNVHKHEPLVLFCESCDTLTCRDCQLNAHKDHQYQFLEDAVRNQRKLLASLVKRLGDKHATLQKSTKEVRSSIRQVSDVQKRVQVDVKMAILQIMKELNKRGRVLVNDAQKVTEGQQERLERQHWTMTKIQKHQEHILRFASWALESDNNTALLLSKKLIYFQLHRALKMIVDPVEPHGEMKFQWDLNAWTKSAEAFGKIVAERPGTNSTGPAPMAPPRAPGPLSKQGSGSSQPMEVQEGYGFGSGDDPYSSAEPHVSGVKRSRSGEGEVSGLMRKVPRVSLERLDLDLTADSQPPVFKVFPGSTTEDYNLIVIERGAAAAATGQPGTAPAGTPGAPPLAGMAIVKEEETEAAIGAPPTATEGPETKPVLMALAEGPGAEGPRLASPSGSTSSGLEVVAPEGTSAPGGGPGTLDDSATICRVCQKPGDLVMCNQCEFCFHLDCHLPALQDVPGEEWSCSLCHVLPDLKEEDGSLSLDGADSTGVVAKLSPANQRKCERVLLALFCHEPCRPLHQLATDSTFSLDQPGGTLDLTLIRARLQEKLSPPYSSPQEFAQDVGRMFKQFNKLTEDKADVQSIIGLQRFFETRMNEAFGDTKFSAVLVEPPPMSLPGAGLSSQELSGGPGDGP

SEQ ID NO: 481 - protein, 835 aa, Homo sapiens; identical to SEQ ID NO: 480

SEQ ID NO: 482 - protein, 199 aa, Homo sapiens
MSSGNAKIGHPAPNFKATAVMPDGQFKDISLSDYKGKYVVFFFYPLDFTFVCPTEIIAFSDRAEEFKKLNCQVIGASVDSHFCHLAWVNTPKKQGGLGPMNIPLVSDPKRTIAQDYGVLKADEGISFRGLFIIDDKGILRQITVNDLPVGRSVDETLRLVQAFQFTDKHGEVCPAGWKPGSDTIKPDVQKSKEYFSKQK

SEQ ID NO: 483 - protein, 199 aa, Homo sapiens; identical to SEQ ID NO: 482

SEQ ID NO: 484 - protein, 199 aa, Homo sapiens; identical to SEQ ID NO: 482

SEQ ID NO: 485 - protein, 199 aa, Homo sapiens; identical to SEQ ID NO: 482

SEQ ID NO: 486 - protein, 199 aa, Homo sapiens; identical to SEQ ID NO: 482

SEQ ID NO: 487 - protein, 199 aa, Homo sapiens; identical to SEQ ID NO: 482

SEQ ID NO: 488 - protein, 199 aa, Homo sapiens; identical to SEQ ID NO: 482

SEQ ID NO: 489 - protein, 254 aa, Homo sapiens
MAISGVPVLGFFIIAVLMSAQESWAIKEEHVIIQAEFYLNPDQSGEFMFDFDGDEIFHVDMAKKETVWRLEEFGRFASFEAQGALANIAVDKANLEIMTKRSNYTPITNVPPEVTVLTNSPVELREPNVLICFIDKFTPPVVNVTWLRNGKPVTTGVSETVFLPREDHLFRKFHYLPFLPSTEDVYDCRVEHWGLDEPLLKHWEFDAPSPLPETTENVVCALGLTVGLVGIIIGTIFIIKGVRKSNAAERRGPL

SEQ ID NO: 490 - protein, 254 aa, Homo sapiens; identical to SEQ ID NO: 489

SEQ ID NO: 491 - protein, 268 aa, Homo sapiens
MAISGVPVLGFFIIAVLMSAQESWAIKEEHVIIQAEFYLNPDQSGEFMFDFDGDEIFHVDMAKKETVWRLEEFGRFASFEAQGALANIAVDKANLEIMTKRSNYTPITNVPPEVTVLTNSPVELREPNVLICFIDKFTPPVVNVTWLRNGKPVTTGVSETVFLPREDHLFRKFHYLPFLPSTEDVYDCRVEHWGLDEPLLKHWEFDAPSPLPETTENVVCALGLTVGLVGIIIGTIFIIKGVMVFLREKITEETSALMTLQSWQYYNP

SEQ ID NO: 492 - protein, 207 aa, Homo sapiens [sequence omitted]

SEQ ID NO: 493 - protein, 881 aa, Homo sapiens
MAAPGAPAEYGYIRTVLGQQILGQLDSSSLALPSEAKLKLAGSSGRGGQTVKSLRIQEQVQQTLARKGRSSVGNGNLHRTSSVPEYVYNLHLVENDFVGGRSPVPKTYDMLKAGTTATYEGRWGRGTAQYSSQKSVEERSLRHPLRRLEISPDSSPERAHYTHSDYQYSQRSQAGHTLHHQESRRAALLVPPRYARSEIVGVSRAGTTSRQRHFDTYHRQYQHGSVSDTVFDSIPANPALLTYPRPGTSRSMGNLLEKENYLTAGLTVGQVRPLVPLQPVTQNRASRSSWHQSSFHSTRTLREAGPSVAVDSSGRRAHLTVGQAAAGGSGNLLTERSTFTDSQLGNADMEMTLERAVSMLEADHMPPSRISAAATFIQHECFQKSEARKRVNQLRGILKLLQLLKVQNEDVQRAVCGALRNLVFEDNDNKLEVAELNGVPRLLQVLKQTRDLETKKQITDHTVNLRSRNGWPGAVAHACNPSTLGGQGGRITRSGVRDQPDQHGLLWNLSSNDKLKNLMITEALLTLTENIIIPFSGWPEGDYPKANGLLDFDIFYNVTGCLRNMSSAGADGRKAMRRCDGLIDSLVHYVRGTIADYQPDDKATENCVCILHNLSYQLEAELPEKYSQNIYIQNRNIQTDNNKSIGCFGSRSRKVKEQYQDVPMPEEKSNPKGVEWLWHSIVIRMYLSLIAKSVRNYTQEASLGALQNLTAGSGPMPTSVAQTVVQKESGLQHTRKMLHVGDPSVKKTAISLLRNLSRNLSLQNEIAKETLPDLVSIIPDTVPSTDLLIETTASACYTLNNIIQNSYQNARDLLNTGGIQKIMAISAGDAYASNKASKAASVLLYSLWAHTELHHAYKKAQFKKTDFVNSRTAKAYHSLKD

SEQ ID NO: 494 - protein, 595 aa, Homo sapiens
MAAPGAPAEYGYIRTVLGQQILGQLDSSSLALPSEAKLKLAGSSGRGGQTVKSLRIQEQVQQTLARKGRSSVGNGNLHRTSSVPEYVYNLHLVENDFVGGRSPVPKTYDMLKAGTTATYEGRWGRGTAQYSSQKSVEERSLRHPLRRLEISPDSSPERAHYTHSDYQYSQRSQAGHTLHHQESRRAALLVPPRYARSEIVGVSRAGTTSRQRHFDTYHRQYQHGSVSDTVFDSIPANPALLTYPRPGTSRSMGNLLEKENYLTAGLTVGQVRPLVPLQPVTQNRASRSSWHQSSFHSTRTLREAGPSVAVDSSGRRAHLTVGQAAAGGSGNLLTERSTFTDSQLGNADMEMTLERAVSMLEADHMLPSRISAAATFIQHECFQKSEARKRVNQLRGILKLLQLLKVQNEDVQRAVCGALRNLVFEDNDNKLEVAELNGVPRLLQVLKQTRDLETKKQITGLLWNLSSNDKLKNLMITEALLTLTENIIIPFSGWPEGDYPKANGLLDFDIFYNVTGCLRNMSSAGADGRKAMRRCDGLIDSLVHYVRGTIADYQPDDKATENCVCILHNLNTRTCRCRRKRATPRAWSGCGIPLL

SEQ ID NO: 495 - protein, 881 aa, Homo sapiens
MAAPGAPAEYGYIRTVLGQQILGQLDSSSLALPSEAKLKLAGSSGRGGQTVKSLRIQEQVQQTLARKGRSSVGNGNLHRTSSVPEYVYNLHLVENDFVGGRSPVPKTYDMLKAGTTATYEGRWGRGTAQYSSQKSVEERSLRHPLRRLEISPDSSPERAHYTHSDYQYSQRSQAGHTLHHQESRRAALLVPPRYARSEIVGVSRAGTTSRQRHFDTYHRQYQHGSVSDTVFDSIPANPALLTYPRPGTSRSMGNLLEKENYLTAGLTVGQVRPLVPLQPVTQNRASRSSWHQSSFHSTRTLREAGPSVAVDSSGRRAHLTVGQAAAGGSGNLLTERSTFTDSQLGNADMEMTLERAVSMLEADHMLPSRISAAATFIQHECFQKSEARKRVNQLRGILKLLQLLKVQNEDVQRAVCGALRNLVFEDNDNKLEVAELNGVPRLLQVLKQTRDLETKKQITDHTVNLRSRNGWPGAVAHACNPSTLGGQGGRITRSGVRDQPDQHGLLWNLSSNDKLKNLMITEALLTLTENIIIPFSGWPEGDYPKANGLLDFDIFYNVTGCLRNMSSAGADGRKAMRRCDGLIDSLVHYVRGTIADYQPDDKATENCVCILHNLSYQLEAELPEKYSQNIYIQNRNIQTDNNKSIGCFGSRSRKVKEQYQDVPMPEEKSNPKGVEWLWHSIVIRMYLSLIAKSVRNYTQEASLGALQNLTAGSGPMPTSVAQTVVQKESGLQHTRKMLHVGDPSVKKTAISLLRNLSRNLSLQNEIAKETLPDLVSIIPDTVPSTDLLIETTASACYTLNNIIQNSYQNARDLLNTGGIQKIMAISAGDAYASNKASKAASVLLYSLWAHTELHHAYKKAQFKKTDFVNSRTAKAYHSLKD

SEQ ID NO: 496 - protein, 837 aa, Homo sapiens
MAAPGAPAEYGYIRTVLGQQILGQLDSSSLALPSEAKLKLAGSSGRGGQTVKSLRIQEQVQQTLARKGRSSVGNGNLHRTSSVPEYVYNLHLVENDFVGGRSPVPKTYDMLKAGTTATYEGRWGRGTAQYSSQKSVEERSLRHPLRRLEISPDSSPERAHYTHSDYQYSQRSQAGHTLHHQESRRAALLVPPRYARSEIVGVSRAGTTSRQRHFDTYHRQYQHGSVSDTVFDSIPANPALLTYPRPGTSRSMGNLLEKENYLTAGLTVGQVRPLVPLQPVTQNRASRSSWHQSSFHSTRTLREAGPSVAVDSSGRRAHLTVGQAAAGGSGNLLTERSTFTDSQLGNADMEMTLERAVSMLEADHMLPSRISAAATFIQHECFQKSEARKRVNQLRGILKLLQLLKVQNEDVQRAVCGALRNLVFEDNDNKLEVAELNGVPRLLQVLKQTRDLETKKQITGLLWNLSSNDKLKNLMITEALLTLTENIIIPFSGWPEGDYPKANGLLDFDIFYNVTGCLRNMSSAGADGRKAMRRCDGLIDSLVHYVRGTIADYQPDDKATENCVCILHNLSYQLEAELPEKYSQNIYIQNRNIQTDNNKSIGCFGSRSRKVKEQYQDVPMPEEKSNPKGVEWLWHSIVIRMYLSLIAKSVRNYTQEASLGALQNLTAGSGPMPTSVAQTVVQKESGLQHTRKMLHVGDPSVKKTAISLLRNLSRNLSLQNEIAKETLPDLVSIIPDTVPSTDLLIETTASACYTLNNIIQNSYQNARDLLNTGGIQKIMAISAGDAYASNKASKAASVLLYSLWAHTELHHAYKKAQFKKTDFVNSRTAKAYHSLKD

SEQ ID NO: 497 - protein, 881 aa, Homo sapiens; identical to SEQ ID NO: 495

SEQ ID NO: 498 - protein, 826 aa, Homo sapiens
MAEPSAPESKHKSSLNSSPWSGLMALGNSRHGHHGPGAQCAHKAAGGAAPPKPAPAGLSGGLSQPAGWQSLLSFTILFLAWLAGFSSRLFAVIRFESIIHEFDPWFNYRSTHHLASHGFYEFLNWFDERAWYPLGRIVGGTVYPGLMITAGLIHWILNTLNITVHIRDVCVFLAPTFSGLTSISTFLLTRELWNQGAGLLAACFIAIVPGYISRSVAGSFDNEGIAIFALQFTYYLWVKSVKTGSVFWTMCCCLSYFYMVSAWGGYVFIINLIPLHVFVLLLMQRYSKRVYIAYSTFYIVGLILSMQIPFVGFQPIRTSEHMAAAGVFALLQAYAFLQYLRDRLTKQEFQTLFFLGVSLAAGAVFLSVIYLTYTGYIAPWSGRFYSLWDTGYAKIHIPIIASVSEHQPTTWVSFFFDLHILVCTFPAGLWFCIKNINDERVFVALYAISAVYFAGVMVRLMLTLTPVVCMLSAIAFSNVFEHYLGDDMKRENPPVEDSSDEDDKRNQGNLYDKAGKVRKHATEQEKTEEGLGPNIKSIVTMLMLMLLMMFAVHCTWVTSNAYSSPSVVLASYNHDGTRNILDDFREAYFWLRQNTDEHARVMSWWDYGYQIAGMANRTTLVDNNTWNNSHIALVGKAMSSNETAAYKIMRTLDVDYVLVIFGGVIGYSGDDINKFLWMVRIAEGEHPKDIRESDYFTPQGEFRVDKAGSPTLLNCLMYKMSYYRFGEMQLDFRTPPGFDRTRNAEIGNKDIKFKHLEEAFTSEHWLVRIYKVKAPDNRETLDHKPRVTNIFPKQKYLSKKTTKRKRGYIKNKLVFKKGKKISKKTV

SEQ ID NO: 499 - protein, 826 aa, Homo sapiens; identical to SEQ ID NO: 498

SEQ ID NO: 500 - protein, 91 aa, Homo sapiens
MKCRRLSEKLSRKRKCILPKGLKLYLSKCTKLPKRLSLKRKCRWCLLKSLKSHLLKCQKLPKRLSAKRKCPWLLLKSLKSHLLKYQSLPKK

SEQ ID NO: 501 - protein, 91 aa, Homo sapiens; identical to SEQ ID NO: 500

SEQ ID NO: 502 - protein, 801 aa, Homo sapiens
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTQENPIYKSPINNFKNPNYGRKAGL

SEQ ID NO: 503 - protein, 798 aa, Homo sapiens [sequence omitted]

SEQ ID NO: 504 - protein, 798 aa, Homo sapiens
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTGENPIYKSAVTTVVNPKYEGK

SEQ ID NO: 505 - protein, 798 aa, Homo sapiens; identical to SEQ ID NO: 504

SEQ ID NO: 506 - protein, 798 aa, Homo sapiens; identical to SEQ ID NO: 504

SEQ ID NO: 507 - protein, 819 aa, Homo sapiens
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTPGVQWCDISSLQPLTSRFQQFSCLSLPSTWDYRVKILFIRVP

SEQ ID NO: 508 - protein, 789 aa, Homo sapiens
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTVSYKTSKKQSGL

SEQ ID NO: 509 - protein, 801 aa, Homo sapiens; identical to SEQ ID NO: 502

SEQ ID NO: 510 - protein, 819 aa, Homo sapiens; identical to SEQ ID NO: 507

SEQ ID NO: 511 - protein, 825 aa, Homo sapiens
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTSLSVAQPGVQWCDISSLQPLTSRFQQFSCLSLPSTWDYRVKILFIRVP

SEQ ID NO: 512 - protein, 789 aa, Homo sapiens; identical to SEQ ID NO: 508

SEQ ID NO: 513 - protein, 801 aa, Homo sapiens; identical to SEQ ID NO: 502

SEQ ID NO: 514 - protein, 819 aa, Homo sapiens; identical to SEQ ID NO: 507

SEQ ID NO: 515 - protein, 801 aa, Homo sapiens; identical to SEQ ID NO: 502

SEQ ID NO: 516 - protein, 819 aa, Homo sapiens; identical to SEQ ID NO: 507

SEQ ID NO: 517 - protein, 798 aa, Homo sapiens; identical to SEQ ID NO: 504

SEQ ID NO: 518 - protein, 825 aa, Homo sapiens; identical to SEQ ID NO: 511

SEQ ID NO: 519 - protein, 798 aa, Homo sapiens; identical to SEQ ID NO: 504

SEQ ID NO: 520 - protein, 798 aa, Homo sapiens; identical to SEQ ID NO: 504

SEQ ID NO: 521 - protein, 789 aa, Homo sapiens; identical to SEQ ID NO: 508

SEQ ID NO: 522 - protein, 682 aa, Homo sapiens
MPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKVESRDKLPQPVQPDPVSHCKEKDVDDCWFYFTYSVNGNNEVMVHVVENPVSHWSRHHSNCSWCGCWNCSYWPCITADMEAFNDNS

SEQ ID NO: 523 - protein, 825 aa, Homo sapiens; identical to SEQ ID NO: 511

SEQ ID NO: 524 - protein, 825 aa, Homo sapiens; identical to SEQ ID NO: 511

SEQ ID NO: 525 - protein, 271 aa, Homo sapiens
MASADSRRVADGGGAGGTFQPYLDTLRQELQQTDPTLLSVVVAVLAVLLTLVFWKLIRSRRSSQRAVLLVGLCDSGKTLLFVRLLTGLYRDTQTSITDSCAVYRVNNNRGNSLTLIDLPGHESLRLQFLERFKSSARAIVFVVDSAAFQREVKDVAEFLYQVLIDSMGLKNTPSFLIACNKQDIAMAKSAKLIQQQLEKELNTLRVTRSAAPSTLDSSSTAPAQLGKKGKEFEFSQLPLKVEFLECSAKGGRGDVGSADIQDLEKWLAKIA

SEQ ID NO: 526 - protein, 200 aa, Homo sapiens
MASADSRRVADGGGAGGTFQPYLDTLRQELQQTDPTLLSVVVAVLAVLLTLVFWKLIRSRRSSQRAVLLVGLCDSGKTLLFVRLLTGLYRDTQTSITDSCAVYRVNNNRGNSLTLIDLPGHESLRLQFLERFKSSARAIVFVVDSAAFQREVKDVAEFLYQVLIDSMGLKNTPSFLIACNKQDIAMAKSAKLIQQQLEKE

SEQ ID NO: 527 - protein, 271 aa, Homo sapiens; identical to SEQ ID NO: 525

SEQ ID NO: 528 - protein, 271 aa, Homo sapiens
MASADSRRVADGGGAGGTFQPYLDTLRQELQQTDPTLLSVVVAVLAVLLTLVFWKLIRSRRSSQRAVLLVGLCDSGKTLLFVRLLTGLYRDTQTSITDSCAVYRVNNNRGNSLTLIDLPGHESLRLQFLERFKSSAGAIVFVVDSAAFQREVKDVAEFLYQVLIDSMGLKNTPSFLIACNKQDIAMAKSAKLIQQQLEKELNTLRVTRSAAPSTLYSSSTAPAQLGKKGKEFEFSQLPLKVEFLECSAKGGRGDVGSADIQDLEKWLAKIA

SEQ ID NO: 529 - protein, 271 aa, Homo sapiens; identical to SEQ ID NO: 525

SEQ ID NO: 530 - protein, 762 aa, Homo sapiens
MSWMLVCDRPEKEQLKMLLLAVLNFTALLIEYSFSRHLYSSIEHLTTLLASSDMQVVLAVLNLLYVFSKRSNYITRLGSDKRTPLLTRLQHLAESWGGKENGFGLAECCRDLQMLKYPPSATTLHFEFYADPGAEVKIEKRTTSNTLHYIHIEQLDKISESPSEIMESLTKMYSIPKDKQMLLFTHIRLAHGFSNHRKRLQAVQARLHAISILVYSNALQESANSILYNGLIEELVDVLQITDKQLMEIKAASLRTLTSIVHLERTPKLSSIIDCTGTASYHGFLPVLVRNCIQAMIDPSMDPYPHQFATALFSFLYHLASYDAGGEALVSCGMMEALLKVIKFLGDEQDQITFVTRAVRVVDLITNLDMAAFQSHSGLSIFIYRLEHEVDLCRKECPFVIKPKIQRPSTTQEGEEMETDMDGVQCIPQRAALLKSMLNFLKKAIQDPAFSDGIRHVMDGSLPTSLKHIISNAEYYGPSLFLLATEVVTVFVFQEPSLLSSLQDNGLTDVMLHALLIKDVPATREVLGSLPNVFSALCLNARGLQSFVQCQPFERLFKVLLSPDYLPAMRRRRSSDPLGDTASNLGSAVDELMRHQPTLKTDATTAIIKLLEEICNLGRDPKYICQKPSIQKADGTATAPPPRSNHAAEEASSEDEEEEEVQAMQSFNSAQQNETEPNQQVVGTEERIPIPLMDYILNVMKFVESILSNNTTDDHCQEFVNQKGLLPLVTILGLPNLPIDFPTSAACQAVAGVCKSILVRNI

SEQ ID NO: 531 - protein, 492 aa, Homo sapiens
MKLLLLHPAFQSCLLLTLLGLWRTTPEAHASSLGAPAISAASFLQDLIHRYGEGDSLTLQQLKALLNHLDVGVGRGNVTQHVQGHRNLSTCFSSGDLFTAHNFSEQSRIGSSELQEFCPTILQQLDSRACTSENQENEENEQTEEGRPSAVEVWGFGFLSVSLINLASLLGVLVLPCTEKAFFSRVLTYFIALSIGTLLSNALFQLIPEAFGFNPLEDYYVSKSAVVFGGFYLFFFTEKILKILLKQKNEHHHGHSHYASESLPSKKDQEEGVMEKLQNGDLDHMIPQHCSSELDGKAPMVDEKVIVGSLSVQDLQASQSACYWLKGVRYSDIGTLAWMITLSDGLHNFIDGLAIGASFTVSVFQGISTSVAILCEEFPHELGDFVILLNAGMSIQQALFFNFLSACCCYLGLAFGILAGSHFSANWIFALAGGMFLYISLADMFPEMNEVCQEDERKGSILIPFIIQNLGLLTGFTIMVVLTMYSGQIQIG

SEQ ID NO: 532 - protein, 492 aa, Homo sapiens
MKLLLLHPAFQSCLLLTLLGLWRTTPEAHASSLGAPAISAASFLQDLIHRYGEGDSLTLQQLKALLNHLDVGVGRGNVTQHVQGHRNLSTCFSSGDLFTAHNFSEQSRIGSSELQEFCPTILQQLDSRACTSENQENEENEQTEEGRPSAVEVWGYGLLCVTVISLCSLLGASVVPFMKKTFYKRLLLYFIALAIGTLYSNALFQLIPEAFGFNPLEDYYVSKSAVVFGGFYLFFFTEKILKILLKQKNEHHHGHSHYASESLPSKKDQEEGVMEKLQNGDLDHMIPQHCSSELDGKAPMVDEKVIVGSLSVQDLQASQSACYWLKGVRYSDIGTLAWMITLSDGLHNFIDGLAIGASFTVSVFQGISTSVAILCEEFPHELGDFVILLNAGMSIQQALFFNFLSACCCYLGLAFGILAGSHFSANWIFALAGGMFLYISLADMFPEMNEVCQEDERKGSILIPFIIQNLGLLTGFTIMVVLTMYSGQIQIG

SEQ ID NO: 533 - protein, 481 aa, Homo sapiens
MKLLLLHPAFQSCLLLTLLGLWRTTPEAHASSLGAPAISAASFLQDLIHRYGEGDSLTLQQLKALLNHLDVGVGRGNVTQHVQGHRNLSTCFSSGDLFTAHNFSEQSRIGSSELQEFCPTILQQLDSRACTSENQENEENEQTEEGRPSAVEVWGYGLLCVTVISLCSLLGASVVPFMKKTFYKRLLLYFIALAIGTLYSNALFQLIPEAFGFNPLEDYYVSKSAVVFGGFYLFFFTEKILKILLKQKNEHHHGHSHYASESLPSKKDQEEGVMEKLQNGDLDHMIPQHCSSELDGKAPMVDEKVIVGSLSVQDLQASQSACYWLKGVRYSDIGTLAWMITLSDGLHNFIDGLAIGASFTVSVFQGISTSVAILCEEFPHELGDFVILLNAGMSIQQALFFNFLSACCCYLGLAFGILAGSHFSANWIFALAGGMFLYISLADMMEFCSVAQAGVQWCHLSSLQPLPLGLKRLSCLSLPSN

SEQ ID NO: 534 - protein, 557 aa, Homo sapiens
MGAGADHSQGREAQEGAGWPVRGVGARVYADAPAKLLLPPPAAWDLAVRLRGAEAASERQVYSVTMKLLLLHPAFQSCLLLTLLGLWRTTPEAHASSLGAPAISAASFLQDLIHRYGEGDSLTLQQLKALLNHLDVGVGRGNVTQHVQGHRNLSTCFSSGDLFTAHNFSEQSRIGSSELQEFCPTILQQLDSRACTSENQENEENEQTEEGRPSAVEVWGYGLLCVTVISLCSLLGASVVPFMKKTFYKRLLLYFIALAIGTLYSNALFQLIPEAFGFNPLEDYYVSKSAVVFGGFYLFFFTEKILKILLKQKNEHHHGHSHYASESLPSKKDQEEGVMEKLQNGDLDHMIPQHCSSELDGKAPMVDEKVIVGSLSVQDLQASQSACYWLKGVRYSDIGTLAWMITLSDGLHNFIDGLAIGASFTVSVFQGISTSVAILCEEFPHELGDFVILLNAGMSIQQALFFNFLSACCCYLGLAFGILAGSHFSANWIFALAGGMFLYISLADMFPEMNEVCQEDERKGSILIPFIIQNLGLLTGFTIMVVLTMYSGQIQIG

SEQ ID NO: 535 - protein, 492 aa, Homo sapiens; identical to SEQ ID NO: 532

SEQ ID NO: 536 - protein, 963 aa, Homo sapiens
MATAAETSASEPEAESKAGPKADGEEDEVKAARTRRKVLSRAVAAATYKTMGPAWDQQEEGVSESDGDEYAMASSAESSPGEYEWEYDEEEEKNQLEIERLEEQLSINVYDYNCHVDLIRLLRLEGELTKVRMARQKMSEIFPLTEELWLEWLHDEISMAQDGLDREHVYDLFEKAVKDYICPNIWLEYGQYSVGGIGQKGGLEKVRSVFERALSSVGLHMTKGLALWEAYREFESAIVEAARLEKVHSLFRRQLAIPLYDMEATFAEYEEWSEDPIPESVIQNYNKALQQLEKYKPYEEALLQAEAPRLAEYQAYIDFEMKIGDPARIQLIFERALVENCLVPDLWIRYSQYLDRQLKVKDLVLSVHNRAIRNCPWTVALWSRYLLAMERHGVDHQVISVTFEKALNAGFIQATDYVEIWQAYLDYLRRRVDFKQDSSKELEELRAAFTRALEYLKQEVEERFNESGDPSCVIMQNWARIEARLCNNMQKARELWDSIMTRGNAKYANMWLEYYNLERAHGDTQHCRKALHRAVQCTSDYPEHVCEVLLTMERTEGSLEDWDIAVQKTETRLARVNEQRMKAAEKEAALVQQEEEKAEQRKRARAEKKALKKKKKIRGPEKRGADEDDEKEWGDDEEEQPSKRRRVENSIPAAGETQNVEVAAGPAGKCAAVDVEPPSKQKEKAASLKRDMPKVLHDSSKDSITVFVSNLPYSMQEPDTKLRPLFEACGEVVQIRPIFSNRGDFRGYCYVEFKEEKSALQALEMDRKSVEGRPMFVSPCVDKSKNPDFKVFRYSTSLEKHKLFISGLPFSCTKEELEEICKAHGTVKDLRLVTNRAGKPKGLAYVEYENESQASQAVMKMDGMTIKENIIKVAISNPPQRKVPEKPETRKAPGGPMLLPQTYGARGKGRTQLSLLPRALQRPSAAAPQAENGPAAAPAVAAPAATEAPKMSNADFAKLFLRK

SEQ ID NO: 537 - protein, 1173 aa, Homo sapiens
EWRPRRLADALSLGLGPGLVEPVDVVDNADGTQTVNYVPSREGPYSISVLYGDEEVPRSPFKVKVLPTHDASKVKASGPGLNTTGVPASLPVEFTIDAKDAGEGLLAVQITDPEGKPKKTHIQDNHDGTYTVAYVPDVTGRYTILIKYGGDEIPFSPYRVRAVPTGDASKCTVTVSIGGHGLGAGIGPTIQIGEETVITVDTKAAGKGKVTCTVCTPDGSEVDVDVVENEDGTFDIFYTAPQPGKYVICVRFGGEHVPNSPFQVTALAGDQPSVQPPLRSQQLAPQYTYAQGGQQTWAPERPLVGVNGLDVTSLRPFDLVIPFTIKKGEITGEVRMPSGKVAQPTITDNKDGTVTVRYAPSEAGLHEMDIRYDNMHIPGSPLQFYVDYVNCGHVTAYGPGLTHGVVNKPATFTVNTKDAGEGGLSLAIEGPSKAEISCTDNQDGTCSVSYLPVLPGDYSILVKYNEQHVPGSPFTARVTGDDSMRMSHLKVGSAADIPINISETDLSLLTATVVPPSGREEPCLLKRLRNGHVGISFVPKETGEHLVHVKKNGQHVASSPIPVVISQSEIGDASRVRVSGQGLHEGHTFEPAEFIIDTRDAGYGGLSLSIEGPSKVDINTEDLEDGTCRVTYCPTEPGNYIINIKFADQHVPGSPFSVKVTGEGRVKESITRRRRAPSVANVGSHCDLSLKIPEISIQDMTAQVTSPSGKTHEAEIVEGENHTYCIRFVPAEMGTHTVSVKYKGQHVPGSPFQFTVGPLGEGGAHKVRAGGPGLERAEAGVPAEFSIWTREAGAGGLAIAVEGPSKAEISFEDRKDGSCGVAYVVQEPGDYEVSVKFNEEHIPDSPFVVPVASPSGDARRLTVSSLQESGLKVNQPASFAVSLNGAKGAIDAKVHSPSGALEECYVTEIDQDKYAVRFIPRENGVYLIDVKFNGTHIPGSPFKIRVGEPGHGGDPGLVSAYGAGLEGGVTGNPAEFVVNTSNAGAGALSVTIDGPSKVKMDCQECPEGYRVTYTPMAPGSYLISIKYGGPYHIGGSPFKAKVTGPRLVSNHSLHETSSVFVDSLTKATCAPQHGAPGPGPADASKVVAKGLGLSKAYVGQKSSFTVDCSKAGNNMLLVGVHGPRTPCEEILVKHVGSRLYSVSYLLKDKGEYTLVVKWGDEHIPGSPYRVVVP

SEQ ID NO: 538 - protein, 72 aa, Homo sapiens
MAKISGPTETARCIESLIAVFQKYAGKDGYNCNLSKTEFPSFMNKELAAFTKNQKDPGVLDRMKKLAVSSDG

SEQ ID NO: 539 - protein, 105 aa, Homo sapiens
MAKISSPTETERCIESLIAVFQKYAGKDGYNYTLSKTEFLSFMNTELAAFTKNQKDPGVLDRMMKKLDTNSDGQLDFSEFLNLIGGLAMACHDSFLKAVPSQKRT

SEQ ID NO: 540 - protein, 105 aa, Homo sapiens; identical to SEQ ID NO: 539

SEQ ID NO: 541 - protein, 102 aa, Homo sapiens
MAKISSPTETERCIESLIAVFQKYAGKDGYNRNLSKTEFLSFMNTELAAFTKNQKDPGVLDHMKKLDVSSDGQLDFPKFLNLIGGLAVACHDSFLKAVPSQK

SEQ ID NO: 542 - protein, 102 aa, Homo sapiens [sequence omitted]

SEQ ID NO: 543 - protein, 1212 aa, Homo sapiens
MEPRPTAPSSGAPGLAGVGETPSAAALAAARVELPGTAVPSVPEDAAPASRDGGGVRDEGPAAAGDGLGRPLGPTPSQSRFQVDLVSENAGRAAAAAAAAAAAAAAAGAGAGAKQTPADGEASGESEPAKGSEEAKGRFRVNFVDPAASSSAEDSLSDAAGVGVDGPNVSFQNGGDTVLSEGSSLHSGGGGGSGHHQHYYYDTHTNTYYLRTFGHNTMDAVPRIDHYRHTAAQLGEKLLRPSLAELHDELEKEPFEDGFANGEESTPTRDAVVTYTAESKGVVKFGWIKGVLVRCMLNIWGVMLFIRLSWIVGQAGIGLSVLVIMMATVVTTITGLSTSAIATNGFVRGGGAYYLISRSLGPEFGGAIGLIFAFANAVAVAMYVVGFAETVVELLKEHSILMIDEINDIRIIGAITVVILLGISVAGMEWEAKAQIVLLVILLLAIGDFVIGTFIPLESKKPKGFFGYKSEIFNENFGPDFREEETFFSVFAIFFPAATGILAGANISGDLADPQSAIPKGTLLAILITTLVYVGIAVSVGSCVVRDATGNVNDTIVTELTNCTSAACKLNFDFSSCESSPCSYGLMNNFQVMSMVSGFTPLISAGIFSATLSSALASLVSAPKIFQALCKDNIYPAFQMFAKGYGKNNEPLRGYILTFLIALGFILIAELNVIAPIISNFFLASYALINFSVFHASLAKSPGWRPAFKYYNMWISLLGAILCCIVMFVINWWAALLTYVIVLGLYIYVTYKKPDVNWGSSTQALTYLNALQHSIRLSGVEDHVKNFRPQCLVMTGAPNSRPALLHLVHDFTKNVGLMICGHVHMGPRRQAMKEMSIDQAKYQRWLIKNKMKAFYAPVHADDLREGAQYLMQAAGLGRMKPNTLVLGFKKDWLQADMRDVDMYINLFHDAFDIQYGVVVIRLKEGLDISHLQGQEELLSSQEKSPGTKDVVVSVEYSKKSDLDTSKPLSEKPITHKVEEEDGKTATQPLLKKESKGPIVPLNVADQKLLEASTQFQKKQGKNTIDVWWLFDDGGLTLLIPYLLTTKKKWKDCKIRVFIGGKINRIDHDRRAMATLLSKFRIDFSDIMVLGDINTKPKKENIIAFEEIIEPYRLHEDDKEQDIADKMKEDEPWRITDNELELYKTKTYRQIRLNELLKEHSSTANIIVMSLPVARKGAVSSALYMAWLEALSKDLPPILLVRGNHQSVLTFYS

SEQ ID NO: 544 - protein, 1212 aa, Homo sapiens; identical to SEQ ID NO: 543

SEQ ID NO: 545 - protein, 1212 aa, Homo sapiens; identical to SEQ ID NO: 543

SEQ ID NO: 546 - protein, 259 aa, Homo sapiens
MAPNIYLVRQRISRLGQRMSGFQINLNPLKEPLGFIKVLEWIASIFAFATCGGFKGQTEIQVNCPPAVTENKTVTATFGYPFRLNEASFQPPPGVNICDVNWKDYVLIGDYSSSAQFYVTFAVFVFLYCIAALLLYVGYTSLYLDSRKLPMIDFVVTLVATFLWLVSTSAWAKALTDIKIATGHNIIDELPPCKKKAVLCYFGSVTSMGSLNVSVIFGFLNMILWGGNAWFVYKETSLHSPSNTSAPHSQGGIPPPTGI

SEQ ID NO: 547 - protein, 259 aa, Homo sapiens; identical to SEQ ID NO: 546

SEQ ID NO: 548 - protein, 241 aa, Homo sapiens
MSGFQINLNPLKEPLGFIKVLEWIASIFAFATCGGFKGQTEIQVNCPPAVTENKTVTATFGYPFRLNEASFQPPPGVNICDVNWKDYVLIGDYSSSAQFYVTFAVFVFLYCIAALLLYVGYTSLYLDSRKLPMIDFVVTLVATFLWLVSTSAWAKALTDIKIATGHNIIDELPPCKKKAVLCYFGSVTSMGSLNVSVIFGFLNMILWGGNAWFVYKETSLHSPSNTSAPHSQGGIPPPTGI

SEQ ID NO: 549 - protein, 259 aa, Homo sapiens; identical to SEQ ID NO: 546

SEQ ID NO: 550 - protein, 725 aa, Homo sapiens
MAAASAVSVLLVAAERNRWHRLPSLLLPPRTWVWRQRTMKYTTATGRNITKVLIANRGEIACRVMRTAKKLGVQTVAVYSEADRNSMHVDMADEAYSIGPAPSQQSYLSMEKIIQVAKTSAAQAIHPGCGFLSENMEFAELCKQEGIIFIGPPPSAIRDMGIKSTSKSIMAAAGVPVVEGYHGEDQSDQCLKEHARRIGYPVMIKAVRGGGGKGMRIVRSEQEFQEQLESARREAKKSFNDDAMLIEKFVDTPRHVEVQVFGDHHGNAVYLFERDCSVQRRHQKIIEEAPAPGIKSEVRKKLGEAAVRAAKAVNYVGAGTVEFIMDSKHNFCFMEMNTRLQVEHPVTEMITGTDLVEWQLRIAAGEKIPLSQEEITLQGHAFEARIYAEDPSNNFMPVAGPLVHLSTPRADPSTRIETGVRQGDEVSVHYDPMIAKLVVWAADRQAALTKLRYSLRQYNIVGLPTNIDFLLNLSGHPEFEAGNVHTDFIPQHHKQLLLSRKAAAKESLCQAALGLILKEKAMTDTFTLQAHDQFSPFSSSSGRRLNISYTRNMTLKDGKNNVAIAVTYNHDGSYSMQIEDKTFQVLGNLYSEGDCTYLKCSVNGVASKAKLIILENTIYLFSKEGSIEIDIPVPKYLSSVSSQETQGGPLAPMTGTIEKVFVKAGDKVKAGDSLMVMIAMKMEHTIKSPKDGTVKKVFYREGAQANRHTPLVEFEEEESDKRESE

SEQ ID NO: 551 - protein, 725 aa, Homo sapiens; identical to SEQ ID NO: 550

SEQ ID NO: 552 - protein, 545 aa, Homo sapiens
MNTVGPYHNRQETYKYFSLPFCVGSKKSISHYHETLGEALQGVELEFSGLDIKFKDDVMPATYCEIDLDKEKRDAFVYAIKNHYWYQMYIDDLPIWGIVGEADENGEDYYLWTYKKLEIGFNGNRIVDVNLTSEGKVKLVPNTKIQMSYSVKWKKSDVKFEDRFDKYLDPSFFQHRIHWFSIFNSFMMVIFLVGLVSMILMRTLRKDYARYSKEEEMDDMDRDLGDEYGWKQVHGDVFRPSSHPLIFSSLIGSGCQIFAVSLIVIIVAMIEDLYTERGSMLSTAIFVYAATSPVNGYFGGSLYARQGGRRWIKQMFIGAFLIPAMVCGTAFFINFIAIYYHASRAIPFGTMVAVCCICFFVILPLNLVGTILGRNLSGQPNFPCRVNAVPRPIPEKKWFMEPAVIVCLGGILPFGSIFIEMYFIFTSFWAYKIYYVYGFMMLVLVILCIVTVCVTIVCTYFLLNAEDYRWQWTSFLSAASTAIYVYMYSFYYYFFKTKMYGLFQTSFYFGYMAVFSTALGIMCGAIGYMGTSAFVRKIYTNVKID

SEQ ID NO: 553 - protein, 589 aa, Homo sapiens
MRPLPGALGVAAAAALWLLLLLLPRTRADEHEHTYQDKEEVVLWMNTVGPYHNRQETYKYFSLPFCVGSKKSISHYHETLGEALQGVELEFSGLDIKFKDDVMPATYCEIDLDKEKRDAFVYAIKNHYWYQMYIDDLPIWGIVGEADENGEDYYLWTYKKLEIGFNGNRIVDVNLTSEGKVKLVPNTKIQMSYSVKWKKSDVKFEDRFDKYLDPSFFQHRIHWFSIFNSFMMVIFLVGLVSMILMRTLRKDYARYSKEEEMDDMDRDLGDEYGWKQVHGDVFRPSSHPLIFSSLIGSGCQIFAVSLIVIIVAMIEDLYTERGSMLSTAIFVYAATSPVNGYFGGSLYARQGGRRWIKQMFIGAFLIPAMVCGTAFFINFIAIYYHASRAIPFGTMVAVCCICFFVILPLNLVGTILGRNLSGQPNFPCRVNAVPRPIPEKKWFMEPAVIVCLGGILPFGSIFIEMYFIFTSFWAYKIYYVYGFMMLVLVILCIVTVCVTIVCTYFLLNAEDYRWQWTSFLSAASTAIYVYMYSFYYYFFKTKMYGLFQTSFYFGYMAVFSTALGIMCGAIGYMGTSAFVRKIYTNVKID

SEQ ID NO: 554 - protein, 589 aa, Homo sapiens; identical to SEQ ID NO: 553

SEQ ID NO: 555 - protein, 589 aa, Homo sapiens; identical to SEQ ID NO: 553

SEQ ID NO: 556 - protein, 165 aa, Homo sapiens
MASGVQVADEVCRIFYDMKVRKCSTPEEIKKRKKAVIFCLSADKKCIIVEEGKEILVGDVGVTITDPFKHFVGMLPEKDCRYALYDASFETKESRKEELMFFLWAPELAPLKSKMIYASSKDAIKKKFQGIKHECQANGPEDLNRACIAEKLGGSLIVAFEGCPV

SEQ ID NO: 557 - protein, 165 aa, Homo sapiens; identical to SEQ ID NO: 556

SEQ ID NO: 558 - protein, 148 aa, Homo sapiens
MKVRKCSTPEEIKKRKKAVIFCLSADKKCIIVEEGKEILVGDVGVTITDPFKHFVGMLPEKDCRYALYDASFETKESRKEELMFFLWAPELAPLKSKMIYASSKDAIKKKFQGIKHECQANGPEDLNRACIAEKLGGSLIVAFEGCPV

SEQ ID NO: 559 - protein, 241 aa, Homo sapiens
MAEPSAATQSHSISSSSFGAEPSAPGGGGSPGACPALGTKSCSSSCAVHDLIFWRDVKKTGFVFGTTLIMLLSLAAFSVISVVSYLILALLSVTISFRIYKSVIQAVQKSEEGHPFKAYLDVDITLSSEAFHNYMNAAMVHINRALKLIIRLFLVEDLVDSLKLAVFMWLMTYVGAVFNGITLLILAELLIFSVPIVYEKYKDPSKTPWNRQKKGRISTWKPEMQQLLKHHLIVITSLLVL

SEQ ID NO: 560 - protein, 236 aa, Homo sapiens
MAEPSAATQSHSISSSSFGAEPSAPGGGGSPGACPALGTKSCSSSCAVHDLIFWRDVKKTGFVFGTTLIMLLSLAAFSVISVVSYLILALLSVTISFRIYKSVIQAVQKSEEGHPFKAYLDVDITLSSEAFHNYMNAAMVHINRALKLIIRLFLVEDLVDSLKLAVFMWLMTYVGAVFNGITLLILAELLIFSVPIVYEKYKTQIDHYVGIARDQTKSIVEKIQAKLPGIAKKKAE

SEQ ID NO: 561 - protein, 247 aa, Homo sapiens
MAEPSAATQSPSISSSSSGAETSASGGSGSPGACPALGTKSCSSSCAVHDLLFWRDVKKTGFVFATTLIMLLSLAAFSVISVVSYLILALLSVTISFRIYKSVIQAVQKSEEGHPIKAYLDVDITLSSEAFHNYMNAAVVHINRALKLIILLFLVEDLVDSLKQAVFMWLMTYVGAFFNGITLLILAELLIFSVPIVYEKYKTQIDHYVGIARHQTKSIVEKIQAKLPGIAKKKGRISTWNQKSNSY

SEQ ID NO: 562 - protein, 236 aa, Homo sapiens; identical to SEQ ID NO: 560

SEQ ID NO: 563 - protein, 236 aa, Homo sapiens; identical to SEQ ID NO: 560

SEQ ID NO: 564 - protein, 236 aa, Homo sapiens
MAEPSAATQSPSISSSSSGAETSASGGSGSPGACPALGTKSCSSSCAVHDLLFWRDVKKTGFVFATTLIMLLSLAAFSVISVVSYLILALLSVTISFRIYKSVIQAVQKSEEGHPIKAYLDVDITLSSEAFHNYMNAAVVHINRALKLIILLFLVEDLVDSLKQAVFMWLMTYVGAFFNGITLLILAELLIFSVPIVYEKYKTQIDHYVGIARHQTKSIVEKIQAKLPGIAKKKAE

SEQ ID NO: 565 - protein, 406 aa, Homo sapiens
MHPAVFLSLPDLRCSLLLLVTWVFTPVTTEITSLDTENIDEILNNADVALVNFYADWCRFSQMLHPIFEEASDVIKEEFPNENQVVFARVDCDQHSDIAQRYRISKYPTLKLFRNGMMMKREYRGQRSVKALADYIRQQKSDPIQEIRDLAEITTLDRSKRNIIGYFEQKDSDNYRVFERVANILHDDCAFLSAFGDVSKPERYSGDNIIYKPPGHSAPDMVYLGAMTNFDVTYNWIQDKCVPLVREITFENGEELTEEGLPFLILFHMKEDTESLEIFQNEVARQLISEKGTINFLHADCDKFRHPLLHIQKTPADCPVIAIDSFRHMYVFGDFKDVLIPGKLKQFVFDLHSGKLHREFHHGPDPTDTAPGEQAQDVASSPPESSFQKLAPSEYRYTLLRDRDEL

SEQ ID NO: 566 - protein, 523 aa, Homo sapiens
MQELEQKEEAAGEEANDGGSGHSLGQEGRESAAGAKADYISRSAPRWAGPGSEGVRGLSGSCPGCSPLEPGSRGRGAAAWRILRCRRLPEPSPFLTQPNLAQSQPPAPVPVTDPSVTMHPAVFLSLPDLRCSLLLLVTWVFTPVTTEITSLDTENIDEILNNADVALVNFYADWCRFSQMLHPIFEEASDVIKEEFPNENQVVFARVDCDQHSDIAQRYRISKYPTLKLFRNGMMMKREYRGQRSVKALADYIRQQKSDPIQEIRDLAEITTLDRSKRNIIGYFEQKDSDNYRVFERVANILHDDCAFLSAFGDVSKPERYSGDNIIYKPPGHSAPDMVYLGAMTNFDVTYNWIQDKCVPLVREITFENGEELTEEGLPFLILFHMKEDTESLEIFQNEVARQLISEKGTINFLHADCDKFRHPLLHIQKTPADCPVIAIDSFRHMYVFGDFKDVLIPGKLKQFVFDLHSGKLHREFHHGPDPTDTAPGEQAQDVASSPPESSFQKLAPSEYRYTLLRDRDEL

SEQ ID NO: 567 - protein, 387 aa, Homo sapiens [sequence omitted]

SEQ ID NO: 568 - protein, 418 aa, Homo sapiens
MSVKMGKKYKNIVLLKGLEVINDYHFRMVKSLLSNDLKLNLKMREEYDKIQIADLMEEKFRGDAGLGKLIKIFEDIPTLEDLAETLKKEKLKVKGPALSRKRKKEVDATSPAPSTSSTVKTEGAEATPGAQKRKKSTKEKAGPKGSKVSEEQTQPPSPAGAGMSTAMGRSPSPKTSLSAPPNSSSTENPKTVAKCQVTPRRNVLQKRPVIVKVLSTTKPFEYETPEMEKKIMFHATVATQTQFFHVKVLNTSLKEKFTPKKIIAIANYVCRNGFLEVYPFTLVADVNADRNMEIPKGLIRSASVTPKINQLCSQTKGSFVNGVFEVHKKNVRGEFTYYEIQDNTGKMEVVVHGRLTTINCEEGDKLKLTCFELAPKSGNTGELRSVIHSHIKVIKTRKNKKDILNPDSSMETSPDFFF

SEQ ID NO: 569 - protein, 72 aa, Homo sapiens [sequence omitted]

SEQ ID NO: 570 - protein, 789 aa, Homo sapiens [sequence omitted]

SEQ ID NO: 571 - protein, 733 aa, Homo sapiens [sequence omitted]

SEQ ID NO: 572 - protein, 733 aa, Homo sapiens [sequence omitted]

SEQ ID NO: 573 - protein, 586 aa, Homo sapiens
MRPLPGALGVAAAALWLLLLLLPRTRADEHEHTYQDKEEVVLWMNTVGPYHNRQETYKYFSLPFCVGSKKSISHYHETLGEALQGVELEFSGLDIKFKDDVMPATYCEIDLDKEKRDAFVYAIKNHYWYQMYIDDLPIWGIVGEADENGEDYYLWTYKKLEIGFNGNRIVDVNLTSEGKVKLGSKYYNPDVIFSKMEKSDVKFEDRFDNILIVLFSHRIHWFSIFNSFMMVIFLVGLVSMILMRTLRKDYARYSKEEEMDDMDRDLGDEYGWKQVHGDVFRPSSHPLIFSSLIGSGCQIFAVSLIVIIVAMIEDLYTERGSMLSTAIFVYAATSPVNGYFGGSLYARQGGRRWIKQMFIGAFLIPAMGVHCLLHQFHSHLLPCFKSHSFWNNGGRLLHLFFCYSSSKSCWYNTWPKSVRSAQLSLSCQCCASSYTGEKMVHGAAVIVCLGGILPFGSIFIEMYFIFTSFWAYKIYYVYGFMMLVLVILCIVTVCVTIVCTYFLLNAEDYRWQWTSFLSAASTAIYVYMYSFYYYFFKTKMYGLFQTSFYFGYMAVFSTALGIMCGAIGYMGTSAFVRKIYTNVKID

SEQ ID NO: 574 - protein, 331 aa, Homo sapiens
MWSRSQVYEVSVKFNEEHIPDSPFVVPVASPSGDARRLTVSSLQESGLKVNQPASFAVSLNGAKGAIDAKVHSPSGALEECYVTEIDQDKYAVRFIPRENGVYLIDVKFNGTHIPGSPFKIRVGEPGHGGDPGLVSAYGAGLEGGVTGNPAEFVVNTSNAGAGALSVTIDGPSKVKMDCQECPEGYRVTYTPMAPGSYLISIKYGGPYHIGGSPFKAKVTGPRLVSNHSLHETSSVFVDSLTKATCAPQHGAPGPGPADASKVVAKGLGLSKAYVGQKSSFTVDCSKAGNNMLLVGVHGPRTPCEEILVKHVGSRLYSVSYLRSPASPASR

SEQ ID NO: 575 - protein, 311 aa, Homo sapiens
MHPDGGQLECLNLRPSGGLLRGAGAQRGWAHTDGPAKWGGPGLRLFLTDTICWFEEGPQAHSMTPCSSDKYAVRFIPRENGVYLIDVKFNGTHIPGSPFKIRVGEPGHGGDPGLVSAYGAGLEGGVTGNPAEFVVNTSNAGAGALSVTIDGPSKVKMDCQECPEGYRVTYTPMAPGSYLISIKYGGPYHIGGSPFKAKVTGPRLVSNHSLHETSSVFVDSLTKATCAPQHGAPGPGPADASKVVAKGLGLSKAYVGQKSSFTVDCSKAGNNMLLVGVHGPRTPCEEILVKHVGSRLYSVSYLRSPASPASR

SEQ ID NO: 576 - protein, 271 aa, Homo sapiens
MEALPLLAATTPDHGRHRRLLLLPLLLFLLPAGAVQGWETEERPRTREEECHFYAGGQVYPGEASRVSVADHSLHLSKAKISKPAPYWEGTAVIDGEFKELKLTDYRGKYLVFFFYPLDFTFVCPTEIIAFGDRLEEFRSINTEVVACSVDSQFTHLAWINTPRRQGGLGPIRIPLLSDLTHQISKDYGVYLEDSGHTLRGLFIIDDKGILRQITLNDLPVGRSVDETLRLVQAFQYTDKHGEVCPAGWKPGSETIIPDPAGKLKYFDKLN

SEQ ID NO: 577 - protein, 271 aa, Homo sapiens; identical to SEQ ID NO: 576

SEQ ID NO: 578 - protein, 2110 aa, Homo sapiens [sequence omitted]

SEQ ID NO: 579 - protein, 2128 aa, Homo sapiens [sequence omitted]

SEQ ID NO: 580 - protein, 1536 aa, Homo sapiens [sequence omitted]

SEQ ID NO: 581 - protein, 1536 aa, Homo sapiens [sequence omitted]

SEQ ID NO: 582 - protein, 417 aa, Homo sapiens
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNEDLENFLQKAPVPSTCSSTFPEELSPPSHQAKREIRFLELQKVASSSSGNNFLSGSPASPMGDILQTPQFQMRRLKKQLADERSNRDELELELAENRKLLTEKDAQIAMMQQRIDRLALLNEKQAASPLEPKELEELRDKNESLTMRLHETLKQCQDLKTEKSQMDRKINQLSEENGDLSFKLREFASHLQQLQDALNELTEEHSKATQEWLEKQAQLEKELSAALQDKVTLCWGHSHSLDHMCKAESSLPLCSSGPLGIKLLSLQGSIVCCN

SEQ ID NO: 583 - protein, 988 aa, Homo sapiens
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNEDLENFLQKAPVPSTCSSTFPEELSPPSHQAKREIRFLELQKVASSSSGNNFLSGSPASPMGDILQTPQFQMRRLKKQLADERSNRDELELELAENRKLLTEKDAQIAMMQQRIDRLALLNEKQAASPLEPKELEELRDKNESLTMRLHETLKQCQDLKTEKSQMDRKINQLSEENGDLSFKLREFASHLQQLQDALNELTEEHSKATQEWLEKQAQLEKELSAALQDKKCLEEKNEILQGKLSQLEEHLSQLQDNPPQEKGEVLGDVLQVEELSKKLADSDQASKVQQQKLKAVQAQGGESQQEAQRLQAQLNELQAQLSQKEQAAEHYKLQMEKAKTHYDAKKQQNQELQEQLRSLEQLQKENKELRAEAERLGHELQQAGLKTKEAEQTCRHLTAQVRSLEAQVAHADQQLRDLGKFQVATDALKSREPQAKPQLDLSIDSLDLSCEEGTPLSITSKLPRTQPDGTSVPGEPASPISQRLPPKVESLESLYFTPIPARSQAPLESSLDSLGDVFLDSGRKTRSARRRTTQIINITMTKKLDVEEPDSANSSFYSTRSAPASQASLRATSSTQSLARLGSPDYGNSALLSLPGYRPTTRSSARRSQAGVSSGAPPGRNSFYMGTCQDEPEQLDDWNRIAELQQRNRVCPPHLKTCYPLESRPSLSLGTITDEEMKTGDPQETLRRASMQPIQIAEGTGITTRQQRKRVSLEPHQGPGTPESKKATSCFPRPMTPRDRHEGRKQSTTEAQKKAAPASTKQADRRQSMAFSILNTPKKLGNSLLRRGASKKALSKASPNTRSGTRRSPRIATTTASAATAAAIGATPRAKGKVEALAGWGRETR

SEQ ID NO: 584 - protein, 2101 aa, Homo sapiens
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNEDLENFLQKAPVPSTCSSTFPEELSPPSHQAKREIRFLELQKVASSSSGNNFLSGSPASPMGDILQTPQFQMRRLKKQLADERSNRDELELELAENRKLLTEKDAQIAMMQQRIDRLALLNEKQAASPLEPKELEELRDKNESLTMRLHETLKQCQDLKTEKSQMDRKINQLSEENGDLSFKLREFASHLQQLQDALNELTEEHSKATQEWLEKQAQLEKELSAALQDKKCLEEKNEILQGKLSQLEEHLSQLQDNPPQEKGEVLGDVLQLETLKQEAATLAANNTQLQARVEMLETERGQQEAKLLAERGHFEEEKQQLSSLITDLQSSISNLSQAKEELEQASQAHGARLTAQVASLTSELTTLNATIQQQDQELAGLKQQAKEKQAQLAQTLQQQEQASQGLRHQVEQLSSSLKQKEQQLKEVAEKQEATRQDHAQQLATAAEEREASLRERDAALKQLEALEKEKAAKLEILQQQLQVANEARDSAQTSVTQAQREKAELSRKVEELQACVETARQEQHEAQAQVAELELQLRSEQQKATEKERVAQEKDQLQEQLQALKESLKVTKGSLEEEKRRAADALEEQQRCISELKAETRSLVEQHKRERKELEEERAGRKGLEARLQQLGEAHQAETEVLRRELAEAMAAQHTAESECEQLVKEVAAWRERYEDSQQEEAQYGAMFQEQLMTLKEECEKARQELQEAKEKVAGIESHSELQISRQQNELAELHANLARALQQVQEKEVRAQKLADDLSTLQEKMAATSKEVARLETLVRKAGEQQETASRELVKEPARAGDRQPEWLEEQQGRQFCSTQAALQAMEREAEQMGNELERLRAALMESQGQQQEERGQQEREVARLTQERGRAQADLALEKAARAELEMRLQNALNEQRVEFATLQEALAHALTEKEGKDQELAKLRGLEAAQIKELEELRQTVKQLKEQLAKKEKEHASGSGAQSEAAGRTEPTGPKLEALRAEVSKLEQQCQKQQEQADSLERSLEAERASRAERDSALETLQGQLEEKAQELGHSQSALASAQRELAAFRTKVQDHSKAEDEWKAQVARGRQEAERKNSLISSLEEEVSILNRQVLEKEGESKELKRLVMAESEKSQKLEERLRLLQAETASNSARAAERSSALREEVQSLREEAEKQRVASENLRQELTSQAERAEELGQELKAWQEKFFQKEQALSTLQLEHTSTQALVSELLPAKHLCQQLQAEQAAAEKRHREELEQSKQAAGGLRAELLRAQRELGELIPLRQKVAEQERTAQQLRAEKASYAEQLSMLKKAHGLLAEENRGLGERANLGRQFLEVELDQAREKYVQELAAVRADAETRLAEVQREAQSTARELEVMTAKYEGAKVKVLEERQRFQEERQKLTAQVEELSKKLADSDQASKVQQQKLKAVQAQGGESQQEAQRLQAQLNELQAQLSQKEQAAEHYKLQMEKAKTHYDAKKQQNQELQEQLRSLEQLQKENKELRAEAERLGHELQQAGLKTKEAEQTCRHLTAQVRSLEAQVAHADQQLRDLGKFQVATDALKSREPQAKPQLDLSIDSLDLSCEEGTPLSITSKLPRTQPDGTSVPGEPASPISQRLPPKVESLESLYFTPIPARSQAPLESSLDSLGDVFLDSGRKTRSARRRTTQIINITMTKKLDVEEPDSANSSFYSTRSAPASQASLRATSSTQSLARLGSPDYGNSALLSLPGYRPTTRSSARRSQAGVSSGAPPGRNSFYMGTCQDEPEQLDDWNRIAELQQRNRVCPPHLKTCYPLESRPSLSLGTITDEEMKTGDPQETLRRASMQPIQIAEGTGITTRQQRKRVSLEPHQGPGTPESKKATSCFPRPMTPRDRHEGRKQSTTEAQKKAAPASTKQADRRQSMAFSILNTPKKLGNSLLRRGASKKALSKASPNTRSGTRRSPRIATTTASAATAAAIGATPRAKGKAKH

SEQ ID NO: 585 - protein, 2101 aa, Homo sapiens; identical to SEQ ID NO: 584

SEQ ID NO: 586 - protein, 2124 aa, Homo sapiens [sequence omitted]

SEQ ID NO: 587 - protein, 277 aa, Homo sapiens
MSSGIHVALVTGGNKGIGLAIVRDLCRLFSGDVVLTARDVTRGQAAVQQLQAEGLSPRFHQLDIDDLQSIRALRDFLRKEYGGLDVLVNNAGIAFKVADPTPFHIQAEVTMKTNFFGTRDVCTELLPLIKPQGRVVNVSSIMSVRALKSCSPELQQKFRSETITEEELVGLMNKFVEDTKKGVHQKEGWPSSAYGVTKIGVTVLSRIHARKLSEQRKGDKILLNACCPGWVRTDMAGPKATKSPEEGAETPVYLALLPPDAEGPHGQFVSEKRVEQW

SEQ ID NO: 588 - protein, 276 aa, Homo sapiens
SSGIHVALVTGGNKGIGLAIVRDLCRLFSGDVVLTARDVTRGQAAVQQLQAEGLSPRFHQLDIDDLQSIRALRDFLRKEYGGLDVLVNNAGIAFKVADPTPFHIQAEVTMKTNFFGTRDVCTELLPLIKPQGRVVNVSSIMSVRALKSCSPELQQKFRSETITEEELVGLMNKFVEDTKKGVHQKEGWPSSAYGVTKIGVTVLSRIHARKLSEQRKGDKILLNACCPGWVRTDMAGPKATKSPEEGAETPVYLALLPPDAEGPHGQFVSEKRVEQW

SEQ ID NO: 589 - protein, 352 aa, Homo sapiens
MASIWVGHRGTVRDYPDFSPSVDAEAIQKAIRGIGTDEKMLISILTERSNAQRQLIVKEYQAAYGKELKDDLKGDLSGHFEHLMVALVTPPAVFDAKQLKKSMKGAGTNEDALIEILTTRTSRQMKDISQAYYTVYKKSLGDDISSETSGDFRKALLTLADVRRDESLKVDEHLAKQDAQILYKAGENRWGTDEDKFTEILCLRSFPQLKLTFDEYRNISQKDIVDSIKGELSGHFEDLLLAIVNCVRNTPAFLAERLHRALKGIGTDEFTLNRIMVSRSEIDLLDIRTEFKKHYGYSLYSAIKSDTSGDYEITLLKMGFPNSSTLLLLILFKRTSKYKQQLVFLTGIFIVL

SEQ ID NO: 590 - protein, 323 aa, Homo sapiens
MASIWVGHRGTVRDYPDFSPSVDAEAIQKAIRGIGTDEKMLISILTERSNAQRQLIVKEYQAAYGKELKDDLKGDLSGHFEHLMVALVTPPAVFDAKQLKKSMKGAGTNEDALIEILTTRTSRQMKDISQAYYTVYKKSLGDDISSETSGDFRKALLTLADGRRDESLKVDEHLAKQDAQILYKAGENRWGTDEDKFTEILCLRSFPQLKLTFDEYRNISQKDIVDSIKGELSGHFEDLLLAIVNCVRNTPAFLAERLHRALKGIGTDEFTLNRIMVSRSEIDLLDIRTEFKKHYGYSLYSAIKSDTSGDYEITLLKICGGDD

SEQ ID NO: 591 - protein, 323 aa, Homo sapiens; identical to SEQ ID NO: 590

SEQ ID NO: 592 - protein, 284 aa, Homo sapiens
MLISILTERSNAQRQLIVKEYQAAYGKELKDDLKGDLSGHFEHLMVALVTPPAVFDAKQLKKSMKGAGTNEDALIEILTTRTSRQMKDISQAYYTVYKKSLGDDISSETSGDFRKALLTLADVRRDESLKVDEHLAKQDAQILYKAGENRWGTDEDKFTEILCLRSFPQLKLTFDEYRNISQKDIVDSIKGELSGHFEDLLLAIVNCVRNTPAFLAERLHRALKGIGTDEFTLNRIMVSRSEIDLLDIRTEFKKHYGYSLYSAIKSDTSGDYEITLLKICGGDD

SEQ ID NO: 593 - protein, 323 aa, Homo sapiens; identical to SEQ ID NO: 590

SEQ ID NO: 594 - protein, 687 aa, Homo sapiens
MAEELVLERCDLELETNGRDHHTADLCREKLVVRRGQPFWLTLHFEGRNYEASVDSLTFSVVTGPAPSQEAGTKARFPLRDAVEEGDWTATVVDQQDCTLSLQLTTPANAPIGLYRLSLEASTGYQGSSFVLGHFILLFNAWCPADAVYLDSEEERQEYVLTQQGFIYQGSAKFIKNIPWNFGQFEDGILDICLILLDVNPKFLKNAGRDCSRRSSPVYVGRVVSGMVNCNDDQGVLLGRWDNNYGDGVSPMSWIGSVDILRRWKNHGCQRVKYGQCWVFAAVACTVLRCLGIPTRVVTNYNSAHDQNSNLLIEYFRNEFGEIQGDKSEMIWNFHCWVESWMTRPDLQPGYEGWQALDPTPQEKSEGTYCCGPVPVRAIKEGDLSTKYDAPFVFAEVNADVVDWIQQDDGSVHKSINRSLIVGLKISTKSVGRDEREDITHTYKYPEGSSEEREAFTRANHLNKLAEKEETGMAMRIRVGQSMNMGSDFDVFAHITNNTAEEYVCRLLLCARTVSYNGILGPECGTKYLLNLNLEPFSEKSVPLCILYEKYRDCLTESNLIKVRALLVEPVINSYLLAERDLYLENPEIKIRILGEPKQKRKLVAEVSLQNPLPVALEGCTFTVEGAGLTEEQKTVEIPDPVEAGEEVKVRMDLLPLHMGLHKLVVNFESDKLKAVKGFRNVIIGPA

SEQ ID NO: 595 - protein, 687 aa, Homo sapiens
MAEELVLERCDLELETNGRDHHTADLCREKLVVRRGQPFWLTLHFEGRNYQASVDSLTFSVVTGPAPSQEAGTKARFPLRDAVEEGDWTATVVDQQDCTLSLQLTTPANAPIGLYRLSLEASTGYQGSSFVLGHFILLFNAWCPADAVYLDSEEERQEYVLTQQGFIYQGSAKFIKNIPWNFGQFQDGILDICLILLDVNPKFLKNAGRDCSRRSSPVYVGRVGSGMVNCNDDQGVLLGRWDNNYGDGVSPMSWIGSVDILRRWKNHGCQRVKYGQCWVFAAVACTVLRCLGIPTRVVTNYNSAHDQNSNLLIEYFRNEFGEIQGDKSEMIWNFHCWVESWMTRPDLQPGYEGWQALDPTPQEKSEGTYCCGPVPVRAIKEGDLSTKYDAPFVFAEVNADVVDWIQQDDGSVHKSINRSLIVGLKISTKSVGRDEREDITHTYKYPEGSSEEREAFTRANHLNKLAEKEETGMAMRIRVGQSMNMGSDFDVFAHITNNTAEEYVCRLLLCARTVSYNGILGPECGTKYLLNLTLEPFSEKSVPLCILYEKYRDCLTESNLIKVRALLVEPVINSYLLAERDLYLENPEIKIRILGEPKQKRKLVAEVSLQNPLPVALEGCTFTVEGAGLTEEQKTVEIPDPVEAGEEVKVRMDLVPLHMGLHKLVVNFESDKLKAVKGFRNVIIGPA

SEQ ID NO: 596 - protein, 687 aa, Homo sapiens; identical to SEQ ID NO: 594

SEQ ID NO: 597 - protein, 687 aa, Homo sapiens; identical to SEQ ID NO: 594

SEQ ID NO: 598 - protein, 548 aa, Homo sapiens
MAEELVLERCDLELETNGRDHHTADLCREKLVVRRGQPFWLTLHFEGRNYEASVDSLTFSVVTGPAPSQEAGTKARFPLRDAVEEGDWTATVVDQQDCTLSLQLTTPANAPIGLYRLSLEASTGYQGSSFVLGHFILLFNAWCPADAVYLDSEEERQEYVLTQQGFIYQGSAKFIKNIPWNFGQFEDGILDICLILLDVNPKFLKNAGRDCSRRSSPVYVGRVVSGMVNCNDDQGVLLGRWDNNYGDGVSPMSWIGSVDILRRWKNHGCQRVKYGQCWVFAAVACTVLRCLGIPTRVVTNYNSAHDQNSNLLIEYFRNEFGEIQGDKSEMIWNFHCWVESWMTRPDLQPGYEGWQALDPTPQEKSEGTYCCGPVPVRAIKEGDLSTKYDAPFVFAEVNADVVDWIQQDDGSVHKSINRSLIVGLKISTKSVGRDEREDITHTYKYPEGSSEEREAFTRANHLNKLAEKEETGMAMRIRVGQSMNMGSDFDVFAHITNNTAEEYVCRLLLCARTVSYNGILGPECGTKYLLNLNLEPFSGKALCSWSIC

SEQ ID NO: 599 - protein, 687 aa, Homo sapiens; identical to SEQ ID NO: 594

SEQ ID NO: 600 - protein, 687 aa, Homo sapiens; identical to SEQ ID NO: 594

SEQ ID NO: 601 - protein, 858 aa, Homo sapiens
MRPMRIFVNDDRHVMAKHSSVYPTQEELEAVQNMVSHTERALKAVSDWIDEQEKGSSEQAESDNMDVPPEDDSKEGAGEQKTEHMTRTLRGVMRVGLVAKGLLLKGDLDLELVLLCKEKPTTALLDKVADNLAIQLAAVTEDKYEILQSVDDAAIVIKNTKEPPLSLTIHLTSPVVREEMEKVLAGETLSVNDPPDVLDRQKCLAALASLRHAKWFQARANGLKSCVIVIRVLRDLCTRVPTWGPLRGWPLELLCEKSIGTANRPMGAGEALRRVLECLASGIVMPDGSGIYDPCEKEATDAIGHLDRQQREDITQSAQHALRLAAFGQLHKVLGMDPLPSKMPKKPKNENPVDYTVQIPPSTTYAITPMKRPMEEDGEEKSPSKKKKKIQKKEEKAEPPQAMNALMRLNQLKPGLQYKLVSQTGPVHAPIFTMSVEVDGNSFEASGPSKKTAKLHVAVKVLQDMGLPTGAEGRDSSKGEDSAEETEAKPAVVAPAPVVEAVSTPSAAFPSDATAENVKQQGPILTKHGKNPVMELNEKRRGLKYELISETGGSHDKRFVMEVEVDGQKFQGAGSNKKVAKAYAALAALEKLFPDTPLALDANKKKRAPVPVRGGPKFAAKPHNPGFGMGGPMHNEVPPPPNLRGRGRGGSIRGRGRGRGFGGANHGGYMNAGAGYGSYGYGGNSATAGQFYSNGGHSGNASGGGGGGGGGSSGYGSYYQGDNYNSPVPPKHAGKKQPHGGQQKPSYGSGYQSHQGQQQSYNQSPYSNYGPPQGKQKGYNHGQGSYSYSNSYNSPGGGGGSDYNYESKFSELASRAPRPGQGPGPSSAAHGVAEARHCPDLWLRALGGGQVVLAAGGC

SEQ ID NO: 602 - protein, 894 aa, Homo sapiens
MRPMRIFVNDDRHVMAKHSSVYPTQEELEAVQNMVSHTERALKAVSDWIDEQEKGSSEQAESDNMDVPPEDDSKEGAGEQKTEHMTRTLRGVMRVGLVAKGLLLKGDLDLELVLLCKEKPTTALLDKVADNLAIQLAAVTEDKYEILQSVDDAAIVIKNTKEPPLSLTIHLTSPVVREEMEKVLAGETLSVNDPPDVLDRQKCLAALASLRHAKWFQARANGLKSCVIVIRVLRDLCTRVPTWGPLRGWPLELLCEKSIGTANRPMGAGEALRRVLECLASGIVMPDGSGIYDPCEKEATDAIGHLDRQQREDITQSAQHALRLAAFGQLHKVLGMDPLPSKMPKKPKNENPVDYTVQIPPSTTYAITPMKRPMEEDGEEKSPSKKKKKIQKKEEKAEPPQAMNALMRLNQLKPGLQYKLVSQTGPVHAPIFTMSVEVDGNSFEASGPSKKTAKLHVAVKVLQDMGLPTGAEGRDSSKGEDSAEETEAKPAVVAPAPVVEAVSTPSAAFPSDATAEQGPILTKHGKNPVMELNEKRRGLKYELISETGGSHDKRFVMEVEVDGQKFQGAGSNKKVAKAYAALAALEKLFPDTPLALDANKKKRAPVPVRGGPKFAAKPHNPGFGMGGPMHNEVPPPPNLRGRGRGGSIRGRGRGRGFGGANHGGYMNAGAGYGSYGYGGNSATAGYSQFYSNGGHSGNASGGGGGGGGGSSGYGSYYQGDNYNSPVPPKHAGKKQPHGGQQKPSYGSGYQSHQGQQQSYNQSPYSNYGPPQGKQKGYNHGQGSYSYSNSYNSPGGGGGSDYNYESKFNYSGSGGRSGGNSYGSGGASYNPGSHGGYGGGSGGGSSYQGKQGGYSQSNYNSPGSGQNYSGPPSSYQSSQGGYGRNADHSMNYQYR

SEQ ID NO: 603 - protein, 894 aa, Homo sapiens [sequence omitted]

SEQ ID NO: 604 - protein, 690 aa, Homo sapiens
MRPMRIFVNDDRHVMAKHSSVYPTQEELEAVQNMVSHTERALKAVSDWIDEQEKGSSEQAESDNMDVPPEDDSKEGAGEQKTEHMTRTLRGVMRVGLVAKGLLLKGDLDLELVLLCKEKPTTALLDKVADNLAIQLAAVTEDKYEILQSVDDAAIVIKNTKEPPLSLTIHLTSPVVREEMEKVLAGETLSVNDPPDVLDRQKCLAALASLRHAKWFQARANGLKSCVIVIRVLRDLCTRVPTWGPLRGWPLELLCEKSIGTANRPMGAGEALRRVLECLASGIVMPDGSGIYDPCEKEATDAIGHLDRQQREDITQSAQHALRLAAFGQLHKVLGMDPLPSKMPKKPKNENPVDYTVQIPPSTTYAITPMKRPMEEDGEEKSPSKKKKKIQKKEEKAEPPQAMNALMRLNQLKPGLQYKLVSQTGPVHAPIFTMSVEVDGNSFEASGPSKKTAKLHVAVKVLQDMGLPTGAEGRDSSKGEDSAEETEAKPAVVAPAPVVEAVSTPSAAFPSDATAEQGPILTKHGKNPVMELNEKRRGLKYELISETGGSHDKRFVMEVEVDGQKFQGAGSNKKVAKAYAALAALEKLFPDTPLALDANKKKRAPVPVRGGPKFAAKPHNPGFGMGGPMHNEVPPPPNLRGRGRGGSIRGRGRGRGFGGANHGGYMNAGAGYGSYGYGGNSATAGYTGFV

SEQ ID NO: 605 - protein, 765 aa, Homo sapiens [sequence omitted]

SEQ ID NO: 606 - protein, 891 aa, Homo sapiens [sequence omitted]

SEQ ID NO: 607 - protein, 894 aa, Homo sapiens; identical to SEQ ID NO: 602

SEQ ID NO: 608 - protein, 702 aa, Homo sapiens
MRPMRIFVNDDRHVMAKHSSVYPTQEELEAVQNMVSHTERALKAVSDWIDEQEKGSSEQAESDNMDVPPEDDSKEGAGEQKTEHMTRTLRGVMRVGLVAKGLLLKGDLDLELVLLCKEKPTTALLDKVADNLAIQLAAVTEDKYEILQSVDDAAIVIKNTKEPPLSLTIHLTSPVVREEMEKVLAGETLSVNDPPDVLDRQKCLAALASLRHAKWFQARANGLKSCVIVIRVLRDLCTRVPTWGPLRGWPLELLCEKSIGTANRPMGAGEALRRVLECLASGIVMPDGSGIYDPCEKEATDAIGHLDRQQREDITQSAQHALRLAAFGQLHKVLGMDPLPSKMPKKPKNENPVDYTVQIPPSTTYAITPMKRPMEEDGEEKSPSKKKKKIQKKEEKAEPPQAMNALMRLNQLKPGLQYKLVSQTGPVHAPIFTMSVEVDGNSFEASGPSKKTAKLHVAVKVLQDMGLPTGAEGRDSSKGEDSAEETEAKPAVVAPAPVVEAVSTPSAAFPSDATAEQGPILTKHGKNPVMELNEKRRGLKYELISETGGSHDKRFVMEVEVDGQKFQGAGSNKKVAKAYAALAALEKLFPDTPLALDANKKKRAPVPVRGGPKFAAKPHNPGFGMGGPMHNEVPPPPNLRGRGRGGSIRGRGRGRGFGGANHGGYMNAGAGYGSYGYGGNSATAGYSDFFTDCYGYHDFGSS

SEQ ID NO: 609 - protein, 898 aa, Homo sapiens
MRPMRIFVNDDRHVMAKHSSVYPTQEELEAVQNMVSHTERALKAVSDWIDEQEKGSSEQAESDNMDVPPEDDSKEGAGEQKTEHMTRTLRGVMRVGLVAKGLLLKGDLDLELVLLCKEKPTTALLDKVADNLAIQLAAVTEDKYEILQSVDDAAIVIKNTKEPPLSLTIHLTSPVVREEMEKVLAGETLSVNDPPDVLDRQKCLAALASLRHAKWFQARANGLKSCVIVIRVLRDLCTRVPTWGPLRGWPLELLCEKSIGTANRPMGAGEALRRVLECLASGIVMPDGSGIYDPCEKEATDAIGHLDRQQREDITQSAQHALRLAAFGQLHKVLGMDPLPSKMPKKPKNENPVDYTVQIPPSTTYAITPMKRPMEEDGEEKSPSKKKKKIQKKEEKAEPPQAMNALMRLNQLKPGLQYKLVSQTGPVHAPIFTMSVEVDGNSFEASGPSKKTAKLHVAVKVLQDMGLPTGAEGRDSSKGEDSAEETEAKPAVVAPAPVVEAVSTPSAAFPSDATAENVKQQGPILTKHGKNPVMELNEKRRGLKYELISETGGSHDKRFVMEVEVDGQKFQGAGSNKKVAKAYAALAALEKLFPDTPLALDANKKKRAPVPVRGGPKFAAKPHNPGFGMGGPMHNEVPPPPNLRGRGRGGSIRGRGRGRGFGGANHGGYMNAGAGYGSYGYGGNSATAGYSQFYSNGGHSGNASGGGGGGGGGSSGYGSYYQGDNYNSPVPPKHAGKKQPHGGQQKPSYGSGYQSHQGQQQSYNQSPYSNYGPPQGKQKGYNHGQGSYSYSNSYNSPGGGGGSDYNYESKFNYSGSGGRSGGNSYGSGGASYNPGSHGGYGGGSGGGSSYQGKQGGYSQSNYNSPGSGQNYSGPPSSYQSSQGGYGRNADHSMNYQYR

SEQ ID NO: 610 - protein, 894 aa, Homo sapiens; identical to SEQ ID NO: 602

SEQ ID NO: 611 - protein, 437 aa, Homo sapiens
MTANGTAEAVQIQFGLINCGNKYLTAEAFGFKVNASASSLKKKQIWTLEQPPDEAGSAAVCLRSHLGRYLAADKDGNVTCEREVPGPDCRFLIVAHDDGRWSLQSEAHRRYFGGTEDRLSCFAQTVSPAEKWSVHIAMHPQVNIYSVTRKRYAHLSARPADEIAVDRDVPWGVDSLITLAFQDQRYSVQTADHRFLRHDGRLVARPEPATGYTLEFRSGKVAFRDCEGRYLAPSGPSGTLKAGKATKVGKDELFALEQSCAQVVLQAANERNVSTRQGMDLSANQDEETDQETFQLEIDRDTKKCAFRTHTGKYWTLTATGGVQSTASSKNASCYFDIEWRDRRITLRASNGKFVTSKKNGQLAASVETADSTGKYWTVGSDSAVTSSGDTPVDFFFEFCDYNKVAIKVGGRYLKGDHAGVLKASAETVDPASLWEY

SEQ ID NO: 612 - protein, 438 aa, Homo sapiens
MTANGTAEAVQIQFGLINCGNKYLTAEAFGFKVNASASSLKKKQIWTLEQPPDEAGSAAVCLRSHLGRYLAADKDGNVTCEREVPGPDCRFLIVAHDDGRWSLQSEAHRRYFGGTEDRLSCFAQTVSPAEKWSVHIAMHPQVNIYSVTRKRYAHLSARPADEIAVDRDVPWGVDSLITLAFQDQRYSVQTADHRFLRHDGRLVARPEPATGYTLEFRSGKVAFRDCEGRYLAPSGPSGTLKAGKATKVGKDELFALEQSCAQVVLQAANERNVSTRQGMDLSANQDEETDQETFQLEIDRDTKKCAFRTHTGKYWTLTATGGVQSTASSKNASCYFDIEWRDRRITLRASNGKFVTSKKNGQLAASVETAGDSELFLMKLINRPIIVFRGEHGFIGCRKVTGTLDANRSSYDVFQLEFNDGAYNIKGRLHRQILDGGQ

SEQ ID NO: 613 - protein, 97 aa, Homo sapiens
AGSAAVCLRSHLGRYLAADKDGNVTCEREVPGPDCRFLTVAHDDGRWSLQSEAHRRSFGGTEDRLSCFAQTVSPAEKWSVHIAMHPQVNIYRVTPKR

SEQ ID NO: 614 - protein, 97 aa, Homo sapiens; identical to SEQ ID NO: 613

SEQ ID NO: 615 - protein, 492 aa, Homo sapiens
TANGTAEAVQIQFGLINCGNKYLTAEAFGFKVNASASSLKKKQIWTLEQPPDEAGSAAVCLRSHLGRYLAADKDGNVTCEREVPGPDCRFLIVAHDDGRWSLQSEAHRRYFGGTEDRLSCFAQTVSPAEKWSVHIAMHPQVNIYSVTRKRYAHLSARPADEIAVDRDVPWGVDSLITLAFQDQRYSVQTADHRFLRHDGRLVARPEPATGYTLEFRSGKVAFRDCEGRYLAPSGPSGTLKAGKATKVGKDELFALEQSCAQVVLQAANERNVSTRQGMDLSANQDEETDQETFQLEIDRDTKKCAFRTHTGKYWTLTATGGVQSTASSKNASCYFDIEWRDRRITLRASNGKFVTSKKNGQLAASVETAGDSELFLMKLINRPIIVFRGEHGFIGCRKVTGTLDANRSSYDVFQLEFNDGAYNIKDSTGKYWTVGSDSAVTSSGDTPVDFFFEFCDYNKVAIKVGGRYLKGDHAGVLKASAETVDPASLWEY

SEQ ID NO: 616 - protein, 493 aa, Homo sapiens
MTANGTAEAVQIQFGLINCGNKYLTAEAFGFKVNASASSLKKKQIWTLEQPPDEAGSAAVCLRSHLGRYLAADKDGNVTCEREVPGPDCRFLIVAHDDGRWSLQSEAHRRYFGGTEDRLSCFAQTVSPAEKWSVHIAMHPQVNIYSVTRKRYAHLSARPADEIAVDRDVPWGVDSLITLAFQDQRYSVQTADHRFLRHDGRLVARPEPATGYTLEFRSGKVAFRDCEGRYLAPSGPSGTLKAGKATKVGKDELFALEQSCAQVVLQAANERNVSTRQGMDLSANQDEETDQETFQLEIDRDTKKCAFRTHTGKYWTLTATGGVQSTASSKNASCYFDIEWRDRRITLRASNGKFVTSKKNGQLAASVETAGDSELFLMKLINRPIIVFRGEHGFIGCRKVTGTLDANRSSYDVFQLEFNDGAYNIKDSTGKYWTVGSDSAVTSSGDTPVDFFFEFCDYNKVAIKVGGRYLKGDHAGVLKASAETVDPASLWEY

SEQ ID NO: 617 - protein, 356 aa, Homo sapiens
MAAEGWIWRWGWGRRCLGRPGLLGPGPGPTTPLFLLLLLGSVTADITDGNSEHLKREHSLIKPYQGVGSSSMPLWDFQGSTMLTSQYVRLTPDERSKEGSIWNHQPCFLKDWEMHVHFKVHGTGKKNLHGDGIALWYTRDRLVPGPVFGSKDNFHGLAIFLDTYPNDETTERVFPYISVMVNNGSLSYDHSKDGRWTELAGCTADFRNRDHDTFLAVRYSRGRLTVMTDLEDKNEWKNCIDITGVRLPTGYYFGASAGTGDLSDNHDIISMKLFQLMVEHTPDEESIDWTKIEPSVNFLKSPKDNVDDPTGNFRSGPLTGWRVFLLLLCALLGIVVCAVVGAVVFQKRQERNKRFY

SEQ ID NO: 618 - protein, 236 aa, Homo sapiens [sequence omitted]

SEQ ID NO: 619 - protein, 356 aa, Homo sapiens; identical to SEQ ID NO: 617

SEQ ID NO: 620 - protein, 471 aa, Homo sapiens
MPNSEPASLLELFNSIATQGELVRSLKAGNASKDEIDSAVKMLVSLKMSYKAAAGEDYKADCPPGNPAPTSNHGPDATEAEEDFVDPWTVQTSSAKGIDYDKLIVRFGSSKIDKELINRIERATGQRPHHFLRRGIFFSHRDMNQVLDAYENKKPFYLYTGRGPSSEAMHVGHLIPFIFTKWLQDVFNVPLVIQMTDDEKYLWKDLTLDQAYGDAVENAKDIIACGFDINKTFIFSDLDYMGMSSGFYKNVVKIQKHVTFNQVKGIFGFTDSDCIGKISFPAIQAAPSFSNSFPQIFRDRTDIQCLIPCAIDQDPYFRMTRDVAPRIGYPKPALLHSTFFPALQGAQTKMSASDPNSSIFLTDTAKQIKTKVNKHAFSGGRDTIEEHRQFGGNCDVDVSFMYLTFFLEDDDKLEQIRKDYTSGAMLTGELKKALIEVLQPLIAEHQARRKEVTDEIVKEFMTPRKLSFDFQ

SEQ ID NO: 621 - protein, 471 aa, Homo sapiens
MPNSEPASLLELFNSIATQGELVRSLKAGNASKDEIDSAVKMLVSLKMSYKAAAGEDYKADCPPGNPAPTSNHGPDATEAEEDFVDPWTVQTSSAKGIDYDKLIVRFGSSKIDKELINRIERATGQRPHHFLRRGIFFSHRDMNQVLDAYENKKPFYLYTGRGPSSEAMHVGHLIPFIFTKWLQDVFNVPLVIQMTDDEKYLWKDLTLDQAYSYAVENAKDIIACGFDINKTFIFSDLDYMGMSSGFYKNVVKIQKHVTFNQVKGIFGFTDSDCIGKISFPAIQAAPSFSNSFPQIFRDRTDIQCLIPCAIDQDPYFRMTRDVAPRIGYPKPALLHSTFFPALQGAQTKMSASDPNSSIFLTDTAKQIKTKVNKHAFSGGRDTIEEHRQFGGNCDVDVSFMYLTFFLEDDDKLEQIRKDYTSGAMLTGELKKALIEVLQPLIAEHQARRKEVTDEIVKEFMTPRKLSFDFQ

SEQ ID NO: 622 - protein, 471 aa, Homo sapiens; identical to SEQ ID NO: 621

SEQ ID NO: 623 - protein, 471 aa, Homo sapiens; identical to SEQ ID NO: 621

SEQ ID NO: 624 - protein, 471 aa, Homo sapiens; identical to SEQ ID NO: 621

SEQ ID NO: 625 - protein, 471 aa, Homo sapiens; identical to SEQ ID NO: 621

SEQ ID NO: 626 - protein, 471 aa, Homo sapiens; identical to SEQ ID NO: 621

SEQ ID NO: 627 - protein, 471 aa, Homo sapiens; identical to SEQ ID NO: 621

SEQ ID NO: 628 - protein, 95 aa, Homo sapiens
QRYPLPTPKEMLSHESGRHSFLQRDCEYPTLREKKQAHYHKACGAGGCPGITCQPRMQLRLSERSGSEQLQMSPRERLFPVWGVCLPPWPHGASL

SEQ ID NO: 629 - protein, 681 aa, Homo sapiens [sequence omitted]

SEQ ID NO: 630 - protein, 698 aa, Homo sapiens
CGIFAYLNYHVPRTRREILETLIKGLQRLEYRGYDSAGVGFDGGNDKDWEANACKIQLIKKKGKVKALDEEVHKQQDMDLDIEFDVHLGIAHTRWATHGEPSPVNSHPQRSDKNNEFIVIHNGIITNYKDLKKFLESKGYDFESETDTETIAKLVKYMYDNRESQDTSFTTLVERVIQQLEGAFALVFKSVHFPGQAVGTRRGSPLLIGVRSEHKLSTDHIPILYRTARTQIGSKFTRWGSQGERGKDKKGSCNLSRVDSTTCLFPVEEKAVEYYFASDASAVIEHTNRVIFLEDDDVAAVVDGRLSIHRIKRTAGDHPGRAVQTLQMELQQIMKGNFSSFMQKEIFEQPESVVNTMRGRVNFDDYTVNLGGLKDHIKEIQRCRRLILIACGTSYHAGVATRQVLEELTELPVMVELASDFLDRNTPVFRDDVCFFLSQSGETADTLMGLRYCKERGALTVGITNTVGSSISRETDCGVHINAGPEIGVASTKAYTSQFVSLVMFALMMCDDRISMQERRKEIMLGLKRLPDLIKEVLSMDDEIQKLATELYHQKSVLIMGRGYHYATCLEGALKIKEITYMHSEGILAGELKHGPLALVDKLMPVIMIIMRDHTYAKCQNALQQVVARQGRPVVICDKEDTETIKNTKRTIKVPHSVDCLQGILSVIPLQLLAFHLAVLRGYDVDFPRNLAKSVTVE

SEQ ID NO: 631 - protein, 115 aa, Homo sapiens
MPMFIVNTNVPRASVPDGFLSELTQQLAQATGKPPQYIAVHVVPDQLMAFGGSSEPCALCSLHSIGKIGGAQNRSYSKLLCGLLAERLRISPDRVYINYYDMNAANVGWNNSTFA

SEQ ID NO: 632 - protein, 114 aa, Homo sapiens
PMFIVNTNVPRASVPDGFLSELTQQLAQATGKPPQYIAVHVVPDQLMAFGGSSEPCALCSLHSIGKIGGAQNRSYSKLLCGLLAERLRISPDRVYINYYDMNAANVGWNNSTFA

SEQ ID NO: 633 - protein, 115 aa, Homo sapiens; identical to SEQ ID NO: 631

SEQ ID NO: 634 - protein, 2725 aa, Homo sapiens
MMNNSGYSDAGLGLGDETDEMPSTEKDLAEDAPWKKIQQNTFTRWCNEHLKCVGKRLTDLQRDLSDGLRLIALLEVLSQKRMYRKFHPRPNFRQMKLENVSVALEFLEREHIKLVSIDSKAIVDGNLKLILGLIWTLILHYSISMPMWEDEDDEDARKQTPKQRLLGWIQNKVPQLPITNFNRDWQDGKALGALVDNCAPGLCPDWEAWDPNQPVENSREAMQQADDWLGVPQVIAPEEIVDPNVDEHSVMTYLSQFPKAKLKPGAPVRSKQLNPKKAIAYGPGIEPQGNTVLQPAHFTVQTVDAGVGEVLVYIEDPEGHTEEAKVVPNNDKDRTYAVSYVPKVAGLHKVTVLFAGQNIERSPFEVNVGMALGDANKVSARGPGLEPVGNVANKPTYFDIYTAGAGTGDVAVVIVDPQGRRDTVEVALEDKGDSTFRCTYRPAMEGPHTVHVAFAGAPITRSPFPVHVSEACNPNACRASGRGLQPKGVRVKEVADFKVFTKGAGSGELKVTVKGPKGTEEPVKVREAGDGVFECEYYPVVPGKYVVTITWGGYAIPRSPFEVQVSPEAGVQKVRAWGPGLETGQVGKSADFVVEAIGTEVGTLGFSIEGPSQAKIECDDKGDGSCDVRYWPTEPGEYAVHVICDDEDIRDSPFIAHILPAPPDCFPDKVKAFGPGLEPTGCIVDKPAEFTIDARAAGKGDLKLYAQDADGCPIDIKVIPNGNGTFRCSYVPTKPIKHTIIISWGGVNVPKSPFRVNVGEGSHPERVKVYGPGVEKTGLKANEPTYFTVDCSEAGQGDVSIGIKCAPGVVGPAEADIDFDIIKNDNDTFTVKYTPPGAGRYTIMVLFANQEIPASPFHIKVDPSHDASKVKAEGPGLNRTGVEVGKPTHFTVLTKGAGKAKLDVQFAGTAKGEVVRDFEIIDNHDYSYTVKYTAVQQGNMAVTVTYGGDPVPKSPFVVNVAPPLDLSKIKVQGLNSKVAVGQEQAFSVNTRGAGGQGQLDVRMTSPSRRPIPCKLEPGGGAEAQAVRYMPPEEGPYKVDITYDGHPVPGSPFAVEGVLPPDPSKVCAYGPGLKGGLVGTPAPFSIDTKGAGTGGLGLTVEGPCEAKIECQDNGDGSCAVSYLPTEPGEYTINILFAEAHIPGSPFKATIRPVFDPSKVRASGPGLERGKVGEAATFTVDCSEAGEAELTIEILSDAGVKAEVLIHNNADGTYHITYSPAFPGTYTITIKYGGHPVPKFPTRVHVQPAVDTSGVKVSGPGVEPHGVLREVTTEFTVDARSLTATGGNHVTARVLNPSGAKTDTYVTDNGDGTYRVQYTAYEEGVHLVEVLYDEVAVPKSPFRVGVTEGCDPTRVRAFGPGLEGGLVNKANRFTVETRGAGTGGLGLAIEGPSEAKMSCKDNKDGSCTVEYIPFTPGDYDVNITFGGRPIPGSPFRVPVKDVVDPGKVKCSGPGLGAGVRARVPQTFTVDCSQAGRAPLQVAVLGPTGVAEPVEVRDNGDGTHTVHYTPATDGPYTVAVKYADQEVPRSPFKIKVLPAHDASKVRASGPGLNASGIPASLPVEFTIDARDAGEGLLTVQILGPEGKPKKANIRDNGDGTYAVSYLPDMSGRYTITIKYGGDEIPYSPFRIHALPTGDASKCLVTVSIGGHGLGACLGPRIQIGQETVITVDAKAAGEGKVTCTVSTPDGAELDVDVVENHDGTFDIYYTAPEPGKYVITIRFGGEHIPNSPFHVLACDPLPHEEEPSEVPQLRQPYAPPRPGARPTHWATEEPVVPVEPMESMLRPFNLVIPFAVQKGELTGEVRMPSGKTARPNITDNKDGTITVRYAPTEKGLHQMGIKYDGNHIPGSPLQFYVDAINSRHVSAYGPGLSHGMVNKPATFTIVTKDAGEGGLSLAVEGPSKAEITCKDNKDGTCTVSYLPTAPGDYSIIVRFDDKHIPGSPFTAKITGDDSMRTSQLNVGTSTDVSLKITESDLSQLTASIRAPSGNEEPCLLKRLPNRHIGISFTPKEVGEHVVSVRKSGKHVTNSPFKILVGPSEIGDASKVRVWGKGLSEGHTFQVAEFIVDTRNAGYGGLGLSIEGPSKVDINCEDMEDGTCKVTYCPTEPGTYIINIKFADKHVPGSPFTVKVTGEGRMKESITRRRQAPSIATIGSTCDLNLKIPGNWFQMVSAQERLTRTFTRSSHTYTRTERTEISKTRGGETKPEVRVEESTQVGGDPFPAVFGDFLGRERLGSFGSITRQQEGEASSQDMTAQVTSPSGKVEAAEIVEGEDSAYSVRFVPQEMGPHTVAVKYRGQHVPGSPFQFTVGPLGEGGAHKVRAGRAGLERGVAGVPAEFSIWTREAGAGGLSIAVEGPSKAEIAFEDRKDGSCGVSYVVQEPGDYEVSIKFNDEHIPDSPFVVPVASLSDDARRLTVTSLQETGLKVNQPASFAVQLNGARGVIDARVHTPSGAVEECYVSELDSDKHTIRFIPHENGVHSIDVKFNGAHIPGSPFKIRVGEQSQAGDPGLVSAYGPGLEGGTTGVSSEFIVNTLNAGSGALSVTIDGPSKVQLDCRECPEGHVVTYTPMAPGNYLIAIKYGGPQHIVGSPFKAKVTGPRLSGGHSLHETSTVLVETVTKSSSSRGSSYSSIPKFSSDASKVVTRGPGLSQAFVGQKNSFTVDCSKAGTNMMMVGVHGPKTPCEEVYVKHMGNRVYNVTYTVKEKGDYILIVKWGDESVPGSPFKVKVP

SEQ ID NO: 635 - protein, 2705 aa, Homo sapiens
MPSTEKDLAEDAPWKKIQQNTFTRWCNEHLKCVGKRLTDLQRDLSDGLRLIALLEVLSQKRMYRKFHPRPNFRQMKLENVSVALEFLEREHIKLVSIDSKAIVDGNLKLILGLIWTLILHYSISMPMWEDEDDEDARKQTPKQRLLGWIQNKVPQLPITNFNRDWQDGKALGALVDNCAPGLCPDWEAWDPNQPVENSREAMQQADDWLGVPQVIAPEEIVDPNVDEHSVMTYLSQFPKAKLKPGAPVRSKQLNPKKAIAYGPGIEPQGNTVLQPAHFTVQTVDAGVGEVLVYIEDPEGHTEEAKVVPNNDKDRTYAVSYVPKVAGLHKVTVLFAGQNIERSPFEVNVGMALGDANKVSARGPGLEPVGNVANKPTYFDIYTAGAGTGDVAVVIVDPQGRRDTVEVALEDKGDSTFRCTYRPAMEGPHTVHVAFAGAPITRSPFPVHVSEACNPNACRASGRGLQPKGVRVKEVADFKVFTKGAGSGELKVTVKGPKGTEEPVKVREAGDGVFECEYYPVVPGKYVVTITWGGYAIPRSPFEVQVSPEAGVQKVRAWGPGLETGQVGKSADFVVEAIGTEVGTLGFSIEGPSQAKIECDDKGDGSCDVRYWPTEPGEYAVHVICDDEDIRDSPFIAHILPAPPDCFPDKVKAFGPGLEPTGCIVDKPAEFTIDARAAGKGDLKLYAQDADGCPIDIKVIPNGNGTFRCSYVPTKPIKHTIIISWGGVNVPKSPFRVNVGEGSHPERVKVYGPGVEKTGLKANEPTYFTVDCSEAGQGDVSIGIKCAPGVVGPAEADIDFDIIKNDNDTFTVKYTPPGAGRYTIMVLFANQEIPASPFHIKVDPSHDASKVKAEGPGLNRTGVEVGKPTHFTVLTKGAGKAKLDVQFAGTAKGEVVRDFEIIDNHDYSYTVKYTAVQQGNMAVTVTYGGDPVPKSPFVVNVAPPLDLSKIKVQGLNSKVAVGQEQAFSVNTRGAGGQGQLDVRMTSPSRRPIPCKLEPGGGAEAQAVRYMPPEEGPYKVDITYDGHPVPGSPFAVEGVLPPDPSKVCAYGPGLKGGLVGTPAPFSIDTKGAGTGGLGLTVEGPCEAKIECQDNGDGSCAVSYLPTEPGEYTINILFAEAHIPGSPFKATIRPVFDPSKVRASGPGLERGKVGEAATFTVDCSEAGEAELTIEILSDAGVKAEVLIHNNADGTYHITYSPAFPGTYTITIKYGGHPVPKFPTRVHVQPAVDTSGVKVSGPGVEPHGVLREVTTEFTVDARSLTATGGNHVTARVLNPSGAKTDTYVTDNGDGTYRVQYTAYEEGVHLVEVLYDEVAVPKSPFRVGVTEGCDPTRVRAFGPGLEGGLVNKANRFTVETRGAGTGGLGLAIEGPSEAKMSCKDNKDGSCTVEYIPFTPGDYDVNITFGGRPIPGSPFRVPVKDVVDPGKVKCSGPGLGAGVRARVPQTFTVDCSQAGRAPLQVAVLGPTGVAEPVEVRDNGDGTHTVHYTPATDGPYTVAVKYADQEVPRSPFKIKVLPAHDASKVRASGPGLNASGIPASLPVEFTIDARDAGEGLLTVQILGPEGKPKKANIRDNGDGTYAVSYLPDMSGRYTITIKYGGDEIPYSPFRIHALPTGDASKCLVTVSIGGHGLGACLGPRIQIGQETVITVDAKAAGEGKVTCTVSTPDGAELDVDVVENHDGTFDIYYTAPEPGKYVITIRFGGEHIPNSPFHVLACDPLPHEEEPSEVPQLRQPYAPPRPGARPTHWATEEPVVPVEPMESMLRPFNLVIPFAVQKGELTGEVRMPSGKTARPNITDNKDGTITVRYAPTEKGLHQMGIKYDGNHIPGSPLQFYVDAINSRHVSAYGPGLSHGMVNKPATFTIVTKDAGEGGLSLAVEGPSKAEITCKDNKDGTCTVSYLPTAPGDYSIIVRFDDKHIPGSPFTAKITGDDSMRTSQLNVGTSTDVSLKITESDLSQLTASIRAPSGNEEPCLLKRLPNRHIGISFTPKEVGEHVVSVRKSGKHVTNSPFKILVGPSEIGDASKVRVWGKGLSEGHTFQVAEFIVDTRNAGYGGLGLSIEGPSKVDINCEDMEDGTCKVTYCPTEPGTYIINIKFADKHVPGSPFTVKVTGEGRMKESITRRRQAPSIATIGSTCDLNLKIPGNWFQMVSAQERLTRTFTRSSHTYTRTERTEISKTRGGETKPEVRVEESTQVGGDPFPAVFGDFLGRERLGSFGSITRQQEGEASSQDMTAQVTSPSGKVEAAEIVEGEDSAYSVRFVPQEMGPHTVAVKYRGQHVPGSPFQFTVGPLGEGGAHKVRAGRAGLERGVAGVPAEFSIWTREAGAGGLSIAVEGPSKAEIAFEDRKDGSCGVSYVVQEPGDYEVSIKFNDEHIPDSPFVVPVASLSDDARRLTVTSLQETGLKVNQPASFAVQLNGARGVIDARVHTPSGAVEECYVSELDSDKHTIRFIPHENGVHSIDVKFNGAHIPGSPFKIRVGEQSQAGDPGLVSAYGPGLEGGTTGVSSEFIVNTLNAGSGALSVTIDGPSKVQLDCRECPEGHVVTYTPMAPGNYLIAIKYGGPQHIVGSPFKAKVTGPRLSGGHSLHETSTVLVETVTKSSSSRGSSYSSIPKFSSDASKVVTRGPGLSQAFVGQKNSFTVDCSKAGTNMMMVGVHGPKTPCEEVYVKHMGNRVYNVTYTVKEKGDYILIVKWGDESVPGSPFKVKVP

SEQ ID NO: 636 - protein, 2725 aa, Homo sapiens
MMNNSGYSDAGLGLGDETDEMPSTEKDLAEDAPWKKIQQNTFTRWCNEHLKCVGKRLTDLQRDLSDGLRLIALLEVLSQKRMYRKFHPRPNFRQMKLENVSVALEFLEREHIKLVSIDSKAIVDGNLKLILGLIWTLILHYSISMPMWEDEDDEDARKQTPKQRLLGWIQNKVPQLPITNFNRDWQDGKALGALVDNCAPGLCPDWEAWDPNQPVENAREAMQQADDWLGVPQVIAPEEIVDPNVDEHSVMTYLSQFPKAKLKPGAPVRSKQLNPKKAIAYGPGIEPQGNTVLQPAHFTVQTVDAGVGEVLVYIEDPEGHTEEAKVVPNNDKDRTYAVSYVPKVAGLHKVTVLFAGQNIERSPFEVNVGMALGDANKVSARGPGLEPVGNVANKPTYFDIYTAGAGTGDVAVVIVDPQGRRDTVEVALEDKGDSTFRCTYRPAMEGPHTVHVAFAGAPITRSPFPVHVSEACNPNACRASGRGLQPKGVRVKEVADFKVFTKGAGSGELKVTVKGPKGTEEPVKVREAGDGVFECEYYPVVPGKYVVTITWGGYAIPRSPFEVQVSPEAGVQKVRAWGPGLETGQVGKSADFVVEAIGTEVGTLGFSIEGPSQAKIECDDKGDGSCDVRYWPTEPGEYAVHVICDDEDIRDSPFIAHILPAPPDCFPDKVKAFGPGLEPTGCIVDKPAEFTIDARAAGKGDLKLYAQDADGCPIDIKVIPNGDGTFRCSYVPTKPIKHTIIISWGGVNVPKSPFRVNVGEGSHPERVKVYGPGVEKTGLKANEPTYFTVDCSEAGQGDVSIGIKCAPGVVGPAEADIDFDIIKNDNDTFTVKYTPPGAGRYTIMVLFANQEIPASPFHIKVDPSHDASKVKAEGPGLNRTGVEVGKPTHFTVLTKGAGKAKLDVQFAGTAKGEVVRDFEIIDNHDYSYTVKYTAVQQGNMAVTVTYGGDPVPKSPFVVNVAPPLDLSKIKVQGLNSKVAVGQEQAFSVNTRGAGGQGQLDVRMTSPSRRPIPCKLEPGGGAEAQAVRYMPPEEGPYKVDITYDGHPVPGSPFAVEGVLPPDPSKVCAYGPGLKGGLVGTPAPFSIDTKGAGTGGLGLTVEGPCEAKIECQDNGDGSCAVSYLPTEPGEYTINILFAEAHIPGSPFKATIRPVFDPSKVRASGPGLERGKVGEAATFTVDCSEAGEAELTIEILSDAGVKAEVLIHNNADGTYHITYSPAFPGTYTITIKYGGHPVPKFPTRVHVQPAVDTSGVKVSGPGVEPHGVLREVTTEFTVDARSLTATGGNHVTARVLNPSGAKTDTYVTDNGDGTYRVQYTAYEEGVHLVEVLYDEVAVPKSPFRVGVTEGCDPTRVRAFGPGLEGGLVNKANRFTVETRGAGTGGLGLAIEGPSEAKMSCKDNKDGSCTVEYIPFTPGDYDVNITFGGRPIPGSPFRVPVKDVVDPGKVKCSGPGLGAGVRARVPQTFTVDCSQAGRAPLQVAVLGPTGVAEPVEVRDNGDGTHTVHYTPATDGPYTVAVKYADQEVPRSPFKIKVLPAHDASKVRASGPGLNASGIPASLPVEFTIDARDAGEGLLTVQILDPEGKPKKANIRDNGDGTYTVSYLPDMSGRYTITIKYGGDEIPYSPFRIHALPTGDASKCLVTVSIGGHGLGACLGPRIQIGQETVITVDAKAAGEGKVTCTVSTPDGAELDVDVVENHDGTFDIYYTAPEPGKYVITIRFGGEHIPNSPFHVLACDPLPHEEEPSEVPQLRQPYAPPRPGARPTHWATEEPVVPVEPMESMLRPFNLVIPFAVQKGELTGEVRMPSGKTARPNITDNKDGTITVRYAPTEKGLHQMGIKYDGNHIPGSPLQFYVDAINSRHVSAYGPGLSHGMVNKPATFTIVTKDAGEGGLSLAVEGPSKAEITCKDNKDGTCTVSYLPTAPGDYSIIVRFDDKHIPGSPFTAKITGDDSMRTSQLNVGTSTDVSLKITESDLSQLTASIRAPSGNEEPCLLKRLPNRHIGISFTPKEVGEHVVSVRKSGKHVTNSPFKILVGPSEIGDASKVRVWGKGLSEGHTFQVAEFIVDTRNAGYGGLGLSIEGPSKVDINCEDMEDGTCKVTYCPTEPGTYIINIKFADKHVPGSPFTVKVTGEGRMKESITRRRQAPSIATIGSTCDLNLKIPGNWFQMVSAQERLTRTFTRSSHTYTRTERTEISKTRGGETKREVRVEESTQVGGDPFPAVFGDFLGRERLGSFGSITRQQEGEASSQDMTAQVTSPSGKVEAAEIVEGEDSAYSVRFVPQEMGPHTVAVKYRGQHVPGSPFQFTVGPLGEGGAHKVRAGGTGLERGVAGVPAEFSIWTREAGAGGLSIAVEGPSKAEIAFEDRKDGSCGVSYVVQEPGDYEVSIKFNDEHIPDSPFVVPVASLSDDARRLTVTSLQETGLKVNQPASFAVQLNGARGVIDARVHTPSGAVEECYVSELDSDKHTIRFIPHENGVHSIDVKFNGAHIPGSPFKIRVGEQSQAGDPGLVSAYGPGLEGGTTGVSSEFIVNTLNAGSGALSVTIDGPSKVQLDCRECPEGHVVTYTPMAPGNYLIAIKYGGPQHIVGSPFKAKVTGPRLSGGHSLHETSTVLVETVTKSSSSRGSSYSSIPKFSSDASKVVTRGPGLSQAFVGQKNSFTVDCSKAGTNMMMVGVHGPKTPCEEVYVKHMGNRVYNVTYTVKEKGDYILIVKWGDESVPGSPFKVKVP

SEQ ID NO: 637 - protein, 201 aa, Homo sapiens [sequence omitted]

SEQ ID NO: 638 - protein, 517 aa, Homo sapiens
MLRAAARFGPRLGRRLLSAAATQAVPAPNQQPEVFCNQIFINNEWHDAVSRKTFPTVNPSTGEVICQVAEGDKEDVDKAVKAARAAFQLGSPWRRMDASHRGRLLNRLADLIERDRTYLAALETLDNGKPYVISYLVDLDMVLKCLRYYAGWADKYHGKTIPIDGDFFSYTRHEPVGVCGQIIPWNFPLLMQAWKLGPALATGNVVVMKVAEQTPLTALYVANLIKEAGFPPGVVNIVPGFGPTAGAAIASHEDVDKVAFTGSTEIGRVIQVAAGSSNLKRVTLELGGKSPNIIMSDADMDWAVEQAHFALFFNQGQCCCAGSRTFVQEDIYDEFVERSVARAKSRVVGNPFDSKTEQGPQVDETQFKKILGYINTGKQEGAKLLCGGGIAADRGYFIQPTVFGDVQDGMTIAKEEIFGPVMQILKFKTIEEVVGRANNSTYGLAAAVFTKDLDKANYLSQALQAGTVWVNCYDVFGAQSPFGGYKMSGSGRELGEYGLQAYTEVKTVTVKVPQKNS

SEQ ID NO: 639 - protein, 419 aa, Homo sapiens
MDASHRGRLLNRLADLIERDRTYLAALETLDNGKPYVISYLVDLDMVLKCLRYYAGWADKYHGKTIPIDGDFFSYTRHEPVGVCGQIIPWNFPLLMQAWKLGPALATGNVVVMKVAEQTPLTALYVANLIKEAGFPPGVVNIVPGFGPTAGAAIASHEDVDKVAFTGSTEIGRVIQVAAGSSNLKRVTLELGGKSPNIIMSDADMDWAVEQAHFALFFNQGQCCCAGSRTFVQEDIYDEFVERSVARAKSRVVGNPFDSKTEQGPQVDETQFKKILGYINTGKQEGAKLLCGGGIAADRGYFIQPTVFGDVQDGMTIAKEEIFGPVMQILKFKTIEEVVGRANNSTYGLAAAVFTKDLDKANYLSQALQAGTVWVNCYDVFGAQSPFGGYKMSGSGRELGEYGLQAYTEVTVKVPQKNS

SEQ ID NO: 640 - protein, 517 aa, Homo sapiens; identical to SEQ ID NO: 638

SEQ ID NO: 641 - protein, 607 aa, Homo sapiens
MEAPAAGLFLLLLLGTWAPAPGSASSEAPPLINEDVKRTVDLSSHLAKVTAEVVLAHLGGGSTSRATSFLLALEPELEARLAHLGVQVKGEDEEENNLEVRETKIKGKSGRFFTVKLPVALDPGAKISVIVETVYTHVLHPYPTQITQSEKQFVVFEGNHYFYSPYPTKTQTMRVKLASRNVESYTKLGNPTRSEDLLDYGPFRDVPAYSQDTFKVHYENNSPFLTITSMTRVIEVSHWGNIAVEENVDLKHTGAVLKGPFSRYDYQRQPDSGISSIRSFKTILPAAAQDVYYRDEIGNVSTSHLLILDDSVEMEIRPRFPLFGGWKTHYIVGYNLPSYEYLYNLGDQYALKMRFVDHVFDEQVIDSLTVKIILPEGAKNIEIDSPYEISRAPDELHYTYLDTFGRPVIVAYKKNLVEQHIQDIVVHYTFNKVLMLQEPLLVVAAFYILFFTVIIYVRLDFSITKDPAAEARMKVACITEQVLTLVNKRIGLYRHFDETVNRYKQSRDISTLNSGKKSLETEHKALTSEIALLQSRLKTEGSDLCDRVSEMQKLDAQVKELVLKSAVEAERLVAGKLKKDTYIENEKLISGKRQELVTKIDHILDAL

SEQ ID NO: 642 - protein, 607 aa, Homo sapiens; identical to SEQ ID NO: 641

SEQ ID NO: 643 - protein, 607 aa, Homo sapiens; identical to SEQ ID NO: 641

SEQ ID NO: 644 - protein, 212 aa, Homo sapiens
MAYAYLFKYIIIGDTGVGKSCLLLQFTDKRFQPVHDLTIGVEFGARMITIDGKQIKLQIWDTAGQESFRSITRSYYRGAAGALLVYDITRRDTFNHLTTWLEDARQHSNSNMVIMLIGNKSDLESRREVKKEEGEAFAREHGLIFMETSAKTASNVEEAFINTAKEIYEKIQEGVFDINNEANGIKIGPQHAATNATHAGNQGGQQAGGGCC

SEQ ID NO: 645 - protein, 212 aa, Homo sapiens; identical to SEQ ID NO: 644

SEQ ID NO: 646 - protein, 216 aa, Homo sapiens
MTYAYLFKYIIIGDTGVGKSCLLLQFTDKRFQPVHDLTIGVEFGARMVNIDGKQIKLQIWDTAGQESFRSITRSYYRGAAGALLVYDITRRETFNHLTSWLEDARQHSSSNMVIMLIGNKSDLESRRDVKREEGEAFAREHGLIFMETSAKTACNVEEAFINTAKEIYRKIQQGLFDVHNEANGIKIGPQQSISTSVGPSASQRNSRDIGSNSGCC

SEQ ID NO: 647 - protein, 212 aa, Homo sapiens; identical to SEQ ID NO: 644

SEQ ID NO: 648 - protein, 108 aa, Homo sapiens
PSGGSPSRLGRAFEAPKLGGGGGAHFVGWAIRDGRGGSGRPGAGLGSPPSLVREVHTLEGVPGLRDSGSVLSLSGVGKSCLLLQFTDKRFQPVHDLTIGKCIYLFQNR

SEQ ID NO: 649 - protein, 216 aa, Homo sapiens; identical to SEQ ID NO: 646

SEQ ID NO: 650 - protein, 216 aa, Homo sapiens; identical to SEQ ID NO: 646

SEQ ID NO: 651 - protein, 664 aa, Homo sapiens
MDSSTWSPKTTAVTRPVETHELIRNAADISIIVIYFVVVMAVGLWAMFSTNRGTVGGFFLAGRSMVWWPIGASLFASNIGSGHFVGLAGTGAASGIAIGGFEWNALVLVVVLGWLFVPIYIKAGVVTMPEYLRKRFGGQRIQVYLSLLSLLLYIFTKISADIFSGAIFINLALGLNLYLAIFLLLAITALYTITGGLAAVIYTDTLQTVIMLVGSLILTGFAFHEVGGYDAFMEKYMKAIPTIVSDGNTTFQEKCYTPRADSFHIFRDPLTGDLPWPGFIFGMSILTLWYWCTDQVIVQRCLSAKNMSHVKGGCILCGYLKLMPMFIMVMPGMISRILYTEKIACVVPSECEKYCGTKVGCTNIAYPTLVVELMPNGLRGLMLSVMLASLMSSLTSIFNSASTLFTMDIYAKVRKRASEKELMIAGRLFILVLIGISIAWVPIVQSAQSGQLFDYIQSITSYLGPPIAAVFLLAIFWKRVNEPGAFWGLILGLLIGISRMITEFAYGTGSCMEPSNCPTIICGVHYLYFAIILFAISFITIVVISLLTKPIPDVHLYRLCWSLRNSKEERIDLDAEEENIQEGPKETIEIETQVPEKKKGIFRRAYDLFCGLEQHGAPKMTEEEEKAMKMKMTDTSEKPLWRTVLNVNGIILVTVAVFCHAYFA

SEQ ID NO: 652 - protein, 664 aa, Homo sapiens; identical to SEQ ID NO: 651

SEQ ID NO: 653 - protein, 641 aa, Homo sapiens
MAKAAAIGIDLGTTYSCVGVFQHGKVEIIANDQGNRTTPSYVAFTDTERLIGDAAKNQVALNPQNTVFDAKRLIGRKFGDPVVQSDMKHWPFQVINDGDKPKVQVSYKGETKAFYPEEISSMVLTKMKEIAEAYLGYPVTNAVITVPAYFNDSQRQATKDAGVIAGLNVLRIINEPTAAAIAYGLDRTGKGERNVLIFDLGGGTFDVSILTIDDGIFEVKATAGDTHLGGEDFDNRLVNHFVEEFKRKHKKDISQNKRAVRRLRTACERAKRTLSSSTQASLEIDSLFEGIDFYTSITRARFEELCSDLFRSTLEPVEKALRDAKLDKAQIHDLVLVGGSTRIPKVQKLLQDFFNGRDLNKSINPDEAVAYGAAVQAAILMGDKSENVQDLLLLDVAPLSLGLETAGGVMTALIKRNSTIPTKQTQIFTTYSDNQPGVLIQVYEGERAMTKDNNLLGRFELSGIPPAPRGVPQIEVTFDIDANGILNVTATDKSTGKANKITITNDKGRLSKEEIERMVQEAEKYKAEDEVQRERVSAKNALESYAFNMKSAVEDEGLKGKISEADKKKVLDKCQEVISWLDANTLAEKDEFEHKRKELEQVCNPIISGLYQGAGGPGPGGFGAQGPKGGSGSGPTIEEVD

SEQ ID NO: 654 - protein, 643 aa, Homo sapiens
MQAPRELAVGIDLGTTYSCVGVFQQGRVEILANDQGNRTTPSYVAFTDTERLVGDAAKSQAALNPHNTVFDAKRLIGRKFADTTVQSDMKHWPFRVVSEGGKPKVPVSYRGEDKTFYPEEISSMVLSKMKETAEAYLGQPVKHAVITVPAYFNDSQRQATKDAGAIAGLNVLRIINEPTAAAIAYGLDRRGAGERNVLIFDLGGGTFDVSVLSIDAGVFEVKATAGDTHLGGEDFDNRLVNHFMEEFRRKHGKDLSGNKRALGRLRTACERAKRTLSSSTQATLEIDSLFEGVDFYTSITRARFEELCSDLFRSTLEPVEKALRDAKLDKAQIHDVVLVGGSTRIPKVQKLLQDFFNGKELNKSINPDEAVAYGAAVQAAVLMGDKCEKVQDLLLLDVAPLSLGLETAGGVMTTLIQRNATIPTKQTQTFTTYSDNQPGVFIQVYEGERAMTKDNNLLGRFELSGIPPAPRGVPQIEVTFDIDANGILSVTATDRSTGKANKITITNDKGRLSKEEVERMVHEAEQYKAEDEAQRDRVAAKNSLEAHVFHVKGSLQEESLRDKIPEEDRRKMQDKCREVLAWLEHNQLAEKEEYEHQKRELEQICRPIFSRLYGGPGVPGGSSCGTQARQGDPSTGPIIEEVD

SEQ ID NO: 655 - protein, 641 aa, Homo sapiens; identical to SEQ ID NO: 653

SEQ ID NO: 656 - protein, 643 aa, Homo sapiens
MQAPRELAVGIDLGTTYSCVGVFQQGRVEILANDQGNRTTPSYVAFTDTERLVGDAAKSQAALNPHNTVFDAKRLIGRKFADTTVQSDMKHWPFRVVSEGGKPKVRVCYRGEDKTFYPEEISSMVLSKMKETAEAYLGQPVKHAVITVPAYFNDSQRQATKDAGAIAGLNVLRIINEPTAAAIAYGLDRRGAGERNVLIFDLGGGTFDVSVLSIDAGVFEVKATAGDTHLGGEDFDNRLVNHFMEEFRRKHGKDLSGNKRALRRLRTACERAKRTLSSSTQATLEIDSLFEGVDFYTSITRARFEELCSDLFRSTLEPVEKALRDAKLDKAQIHDVVLVGGSTRIPKVQKLLQDFFNGKELNKSINPDEAVAYGAAVQAAVLMGDKCEKVQDLLLLDVAPLSLGLETAGGVMTTLIQRNATIPTKQTQTFTTYSDNQPGVFIQVYEGERAMTKDNNLLGRFELSGIPPAPRGVPQIEVTFDIDANGILSVTATDRSTGKANKITITNDKGRLSKEEVERMVHEAEQYKAEDEAQRDRVAAKNSLEAHVFHVKGSLQEESLRDKIPEEDRRKMQDKCREVLAWLEHNQLAEKEEYEHQKRELEQICRPIFSRLYGGPGVPGGSSCGTQARQGDPSTGPIIEEVD

SEQ ID NO: 657 - protein, 641 aa, Homo sapiens
MAKAAAIGIDLGTTYSCVGVFQHGKVEIIANDQGNRTTPSYVAFTDTERLIGDAAKNQVALNPQNTVFDAKRLIGRKFGDPVVQSDMKHWPFQVINDGDKPKVQVSYKGETKAFYPEEISSMVLTKMKEIAEAYLGYPVTNAVITVPAYFNDSQRQATKDAGVIAGLNVLRIINEPTAAAIAYGLDRTGKGERNVLIFDLGGGTFDVSILTIDDGIFEVKATAGDTHLGGEDFDNRLVNHFVEEFKRKHKKDISQNKRAVRRLRTACERAKRTLSSSTQASLEIDSLFEGIDFYTSITRARFEELCSDLFRSTLEPVEKALRDAKLDKAQIHDLVLVGGSTRIPKVQKLLQDFFNGRDLNKSINPDEAVAYGAAVQAAILMGDKSENVQDLLLLDVAPLSLGLETAGGVMTALIKRNSTIPTKQTQIFTTYSDNQPGVLIQVYEGERAMTKDNNLLGRFELSGIPPAPRGVPQIEVTFDIDANGILNVTATDKSTGKASKITITNDKGRLSKEEIERMVQEAEKYKAEDEVQRERVSAKNALESYAFNMKSAVEDEGLKGKISEADKKKVLDKCQEVISWLDANTLAEKDEFEHKRKELEQVCNPIISGLYQGAGGPGPGGFGAQGPKGGSGSGPTIEEVD

SEQ ID NO: 658 - protein, 641 aa, Homo sapiens; identical to SEQ ID NO: 653

SEQ ID NO: 659 - protein, 367 aa, Homo sapiens
MQAPRELAVGIDLGTTYSCVGVFQQGRVEILANDQGNRTTPSYVAFTDTERLVGDAAKSQAALNPHNTVFDAKRLIGRKFADTTVQSDMKHWPFQVVSEGGKPKVRVCYRGEDKTFYPEEISSMVLSKMKETAEAYLGQPVKHAVITVPTYFSNSQRQATKDAGAIAGLKVLPIINEATAAAIAYGLDRRGAGKRNVLIFDLGGGTFDVSVLSIDAGVFEVKATAGDTHLGGEDFDNRLVNHFMEEFRRKHGKDLSGNKRALRRLRTACERAKRTPSSSTQATLEIDSLFEGVDFYKSITRARFEELCSDLFRSTLEPVEKALRDAKLDKAQIHDFVLGGGLHSHPQGAEVAAGLLQRQGAEQEHQP

SEQ ID NO: 660 - protein, 703 aa, Homo sapiens
MTKFGFLRLSYEKQDTLLKLLILSMAAVLSFSTRLFAVLRFESVIHEFDPYFNYRTTRFLAEEGFYKFHNWFDDRAWYPLGRIIGGTIYPGLMITSAAIYHVLHFFHITIDIRNVCVFLAPLFSSFTTIVTYHLTKELKDAGAGLLAAAMIAVVPGYISRSVAGSYDNEGIAIFCMLLTYYMWIKAVKTGSICWAAKCALAYFYMVSSWGGYVFLINLIPLHVLVLMLTGRFSHRIYVAYCTVYCLGTILSMQISFVGFQPVLSSEHMAAFGVFGLCQIHAFVDYLRSKLNPQQFEVLFRSVISLVGFVLLTVGALLMLTGKISPWTGRFYSLLDPSYAKNNIPIIASVSEHQPTTWSSYYFDLQLLVFMFPVGLYYCFSNLSDARIFIIMYGVTSMYFSAVMVRLMLVLAPVMCILSGIGVSQVLSTYMKNLDISRPDKKSKKQQDSTYPIKNEVASGMILVMAFFLITYTFHSTWVTSEAYSSPSIVLSARGGDGSRIIFDDFREAYYWLRHNTPEDAKVMSWWDYGYQITAMANRTILVDNNTWNNTHISRVGQAMASTEEKAYEIMRELDVSYVLVIFGGLTGYSSDDINKFLWMVRIGGSTDTGKHIKENDYYTPTGEFRVDREGSPVLLNCLMYKMCYYRFGQVYTEAKRPPGFDRVRNAEIGNKDFELDVLEEAYTTEHWLVRIYKTLFDFINQQF

SEQ ID NO: 661 - protein, 705 aa, Homo sapiens
MTKFGFLRLSYEKQDTLLKLLILSMAAVLSFSTRLFAVLRFESVIHEFDPYFNYRTTRFLAEEGFYKFHNWFDDRAWYPLGRIIGGTIYPGLMITSAAIYHVLHFFHITIDIRNVCVFLAPLFSSFTSIVTYLLTKELKDAGAGLLAAAMIAVVPGYISRSVAGSYDNEGIAIFCMLLTYYMWIKAVKTGSICWAAKCALAYFYMVSSWGGYVFLINLIPLHVLVLMLTGRFSHRIYVAYCTVYCLGTILSRQISFVGFQPVLSSEHMAGFGVFGLCQIHAFVDYLRSKLNPQQFEVLFRSVISLVGFVLLTVGALLMLTGKISPWTGRFYSLLDPSYAKNNIPIIASVSEHQPTTWSSYYFDLQLLVFMFPVGLYYCFSNLSDARIFIIMYGVTSMYFSAVMVRLMLVLAPVMSILSGIGVSQVLSTYMKNLDISRPDKKSKKQQDSTYPIKIEVASGMILVMAFFLITYTFHSTWVTSEAYSSPSIVLSARGGDGSRIIFDDFREAYYWLRHNTPEDAKVMSWWDYGYQITAMANRTILVDNNTWNNTHISRVGQAMASTEEKAYEIMRELDVSYVLVIFGGLTGYSSDDINKFLWMVRIGGSTDTGKHIKENDYYTPTGEFRVDREGSPVLLNCLMYKMCYYRFGQVYTEAKRPPGFDRVRNAEIGNKDFELDVLEEGYTTEHWLVRIYKVKDLDNRGLSRT

SEQ ID NO: 662 - protein, 705 aa, Homo sapiens
MTKFGFLRLSYEKQDTLLKLLILSMAAVLSFSTRLFAVLRFESVIHEFDPYFNYRTTRFLAEEGFYKFHNWFDDRAWYPLGRIIGGTIYPGLMITSAAIYHVLHFFHITIDIRNVCVFLAPLFSSFTTIVTYHLTKELKDAGAGLLAAAMIAVVPGYISRSVAGSYDNEGIAIFCMLLTYYMWIKAVKTGSICWAAKCALAYFYMVSSWGGYVFLINLIPLHVLVLMLTGRFSHRIYVAYCTVYCLGTILSMQISFVGFQPVLSSEHMAAFGVFGLCQIHAFVDYLRSKLNPQQFEVLFRSVISLVGFVLLTVGALLMLTGKISPWTGRFYSLLDPSYAKNNIPIIASVSEHQPTTWSSYYFDLQLLVFMFPVGLYYCFSNLSDARIFIIMYGVTSMYFSAVMVRLMLVLAPVMCILSGIGVSQVLSTYMKNLDISRPDKKSKKQQDSTYPIKNEVASGMILVMAFFLITYTFHSTWVTSEAYSSPSIVLSARGGDGSRIIFDDFREAYYWLRHNTPEDAKVMSWWDYGYQITAMANRTILVDNNTWNNTHISRVGQAMASTEEKAYEIMRELDVSYVLVIFGGLTGYSSDDINKFLWMVRIGGSTDTGKHIKENDYYTPTGEFRVDREGSPVLLNCLMYKMCYYRFGQVYTEAKRPPGFDRVRNAEIGNKDFELDVLEEAYTTEHWLVRIYKVKDLDNRGLSRT

SEQ ID NO: 663 - protein, 703 aa, Homo sapiens; identical to SEQ ID NO: 660

SEQ ID NO: 664 - protein, 219 aa, Homo sapiens
MGYFRCAGAGSFGRRRKMEPSTAARAWALFWLLLPLLGAVCASGPRTLVLLDNLNVRETHSLFFRSLKDRGFELTFKTADDPSLSLIKYGEFLYDNLIIFSPSVEDFGGNINVETISAFIDGGGSVLVAASSDIGDPLRELGSECGIEFDEEKTAVIDHHNYDISDLGQHTLIVADTENLLKAPTIVGKSSLNPIPSPHSVETGQGGGLLGLVVLFCFV

SEQ ID NO: 665 - protein, 456 aa, Homo sapiens
MGYFRCAGAGSFGRRRKMEPSTAARAWALFWLLLPLLGAVCASGPRTLVLLDNLNVRETHSLFFRSLKDRGFELTFKTADDPSLSLIKYGEFLYDNLIIFSPSVEDFGGNINVETISAFIDGGGSVLVAASSDIGDPLRELGSECGIEFDEEKTAVIDHHNYDISDLGQHTLIVADTENLLKAPTIVGKSSLNPILFRGVGMVADPDNPLVLDILTGSSTSYSFFPDKPITQYPHAVGKNTLLIAGLQARNNARVIFSGSLDFFSDSFFNSAVQKAAPGSQRYSQTGNYELAVALSRWVFKEEGVLRVGPVSHHRVGETAPPNAYTVTDLVEYSIVIQQLSNGKWVPFDGDDIQLEFVRIDPFVRTFLKKKGGKYSVQFKLPDVYGVFQFKVDYNRLGYTHLYSSTQVSVRPLQHTQYERFIPSAYPYYASAFPMMLGLFIFSIVFLHMKEKEKSD

SEQ ID NO: 666 - protein, 456 aa, Homo sapiens
MGYFRCAGAGSFGRRRKMEPSTAARAWALFWLLLPLLGAVCASGPRTLVLLDNLNVRETHSLFFRSLKDRGFELTFKTADDPSLSLIKYGEFLYDNLIIFSPSVEDFGGNINVETISAFIDGGGSVLVAASSDIGDPLRELGSECGIEFDEEKTAVIDHHNYDISDLGQHTLIVADTENLLKAPTIVGKSSLNPILFRGVGMVADPDNPLVLDILTGSSTSYSFFPDKPITQYPHAVGKNTLLIAGLQARNNARVIFSGSLDFFSDSFFNSAVQKAAPGSQRYSQTGNYELAVALSRWVFKEEGVLRVGPVSHHRVGETAPPNAYTVTDLVEYSIVIQQLSNGKWVPFDGDDIQLEFVRIDPFVRTFLKKKGGKYSVQFKLPDVYGVFQFKVDYNRLGYTHLYSSTQVSVRPLQHTQYERFIPSAYPYYASAFSMMLGLFIFSIVFLHMKEKEKSD

SEQ ID NO: 667 - protein, 456 aa, Homo sapiens; identical to SEQ ID NO: 666

SEQ ID NO: 668 - protein, 2432 aa, Homo sapiens
MLGLLVQFCTSHKEMDVSALLDFYMKNILMSKVKPPKYLLDSCAPLLRYLSHSEFKDLILPTIQKSLLRSPENVIETISSLLASVTLDLSQYAMDIVKGLAGHLKSNSPRLMDEAVLALRNLARQCSDSSAMESLTKHLFAILGGSEGKLTVVAQKMSVLSGIGSVSHHVVSGPSSQVLNGIVAELFIPFLQQEVHEGTLVHAVSVLALWCNRFTMEVPKKLTEWFKKAFSLKTSTSAVRHAYLQCMLASYRGDTLLQALDLLPLLIQTVEKAASQSTQVPTITEGVAAALLLLKLSVADSQAEAKLSSFWQLIVDEKKQVFTSEKFLVMASEDALCTVLHLTERLFLDHPHRLTGNKVQQYHRALVAVLLSRTWHVRRQAQQTVRKLLSSLGGFKLAHGLLEELKTVLSSHKVLPLEALVTDAGEVTEAGKAYVPPRVLQEALCVISGVPGLKGDVTDTEQLAQEMLIISHHPSLGPWLRWSSMNAMGSLSVLSPDRVLPQLISTITASVQNPALRLVTREEFAIMQTPAGELYDKSIIQSAQQDSIKKANMKRENKAYSFKEQIIELELKEEIKKKKGIKEEVQLTSKQKEMLQAQLDREAQVRRRLQELDGELEAALGLLDIILAKNPSGLTQYIPVLVDSFLPLLKSPLAAPRIKNPFLSLAACVMPSRLKALGTLVSHVTLRLLKPECVLDKSWCQEELSVAVKRAVMLLHTHTITSRVGKGEPGAAPLSAPAFSLVFPFLKMVLTEMPHHSEEEEEWMAQILQILTVQAQLRASPNTPPGRVDENGPELLPRVAMLRLLTWVIGTGSPRLQVLASDTLTTLCASSSGDDGCAFAEQEEVDVLLCALQSPCASVRETVLRGLMELHMVLPAPDTDEKNGLNLLRRLWVVKFDKEEEIRKLAERLWSMMGLDLQPDLCSLLIDDVIYHEAAVRQAGAEALSQAVARYQRQAAEVMGRLMEIYQEKLYRPPPVLDALGRVISESPPDQWEARCGLALALNKLSQYLDSSQVKPLFQFFVPDALNDRHPDVRKCMLDAALATLNTHGKENVNSLLPVFEEFLKNAPNDASYDAVRQSVVVLMGSLAKHLDKSDPKVKPIVAKLIAALSTPSQQVQESVASCLPPLVPAIKEDAGGMIQRLMQQLLESDKYAERKGAAYGLAGLVKGLGILSLKQQEMMAALTDAIQDKKNFRRREGALFAFEMLCTMLGKLFEPYVVHVLPHLLLCFGDGNQYVREAADDCAKAVMSNLSAHGVKLVLPSLLAALEEESWRTKAGSVELLGAMAYCAPKQLSSCLPNIVPKLTEVLTDSHVKVQKAGQQALRQIGSVIRNPEILAIAPVLLDALTDPSRKTQKCLQTLLDTKFVHFIDAPSLALIMPIVQRAFQDRSTDTRKMAAQIIGNMYSLTDQKDLAPYLPSVTPGLKASLLDPVPEVRTVSAKALGAMVKGMGESCFEDLLPWLMETLTYEQSSVDRSGAAQGLAEVMAGLGVEKLEKLMPEIVATASKVDIAPHVRDGYIMMFNYLPITFGDKFTPYVGPIIPCILKALADENEFVRDTALRAGQRVISMYAETAIALLLPQLEQGLFDDLWRIRFSSVQLLGDLLFHISGVTGKMTTETASEDDNFGTAQSNKAIITALGVERRNRVLAGLYMGRSDTQLVVRQASLHVWKIVVSNTPRTLREILPTLFGLLLGFLASTCADKRTIAARTLGDLVRKLGEKILPEIIPILEEGLRSQKSDERQGVCIGLSEIMKSTSRDAVLYFSESLVPTARKALCDPLEEVREAAAKTFEQLHSTIGHQALEDILPFLLKQLDDEEVSEFALDGLKQVMAIKSRVVLPYLVPKLTTPPVNTRVLAFLSSVAGDALTRHLGVILPAVMLALKEKLGTPDEQLEMANCQAVILSVEDDTGHRIIIEDLLEATRSPEVGMRQAAAIILNIYCSRSKADYTSHLRSLVSGLIRLFNDSSPVVLEESWDALNAITKKLDAGNQLALIEELHKEIRLIGNESKGEHVPGFCLPKKGVTSILPVLREGVLTGSPEQKEEAAKALGLVIRLTSADALRPSVVSITGPLIRILGDRFSWNVKAALLETLSLLLAKVGIALKPFLPQLQTTFTKALQDSNRGVRLKAADALGKLISIHIKVDPLFTELLNGIRAMEDPGVRDTMLQALRFVIQGAGAKVDAVIRKNIVSLLLSMLGHDEDNTRISSAGCLGELCAFLTEEELSAVLQQCLLADVSGIDWMVRHGRSLALSVAVNVAPGRLCAGRYSSDVQEMILSSATADRIPIAVSGVRGMGFLMRHHIETGGGQLPAKLSSLFVKCLQNPSSDIRLVAEKMIWWANKDPLPPLDPQAIKPILKALLDNTKDKNTVVRAYSDQAIVNLLKMRQGEEVFQSLSKILDVASLEVLNEVNRRSLKKLASQADSTEQVDDTILT

SEQ ID NO: 669 - protein, 2468 aa, Homo sapiens
MLGLLVQFCTSHKEMDVSALLDFYMKNILMSKVKPPKYLLDSCAPLLRYLSHSEFKDLILPTIQKSLLRSPENVIETISSLLASVTLDLSQYAMDIVKGLAGHLKSNSPRLMDEAVLALRNLARQCSDSSAMESLTKHLFAILGGSEGKLTVVAQKMSVLSGIGSVSHHVVSGPSSQVLNGIVAELFIPFLQQEVHEGTLVHAVSVLALWCNRFTMEVPKKLTEWFKKAFSLKTSTSAVRHAYLQCMLASYRGDTLLQALDLLPLLIQTVEKAASQSTQVPTITEGVAAALLLLKLSVADSQAEAKLSSFWQLIVDEKKQVFTSEKFLVMASEDALCTVLHLTERLFLDHPHRLTGNKVQQYHRALVAVLLSRTWHVRRQAQQTVRKLLSSLGGFKLAHGLLEELKTVLSSHKVLPLEALVTDAGEVTEAGKAYVPPRVLQEALCVISGVPGLKGDVTDTEQLAQEMLIISHHPSLVAVQSGLWPALLARMKIDPEAFITRHLDQIIPRMTTQSPLNQSSMNAMGSLSVLSPDRVLPQLISTITASVQNPALRLVTREEFAIMQTPAGELYDKSIIQSAQQDSIKKANMKRENKAYSFKEQIIELELKEEIKKKKGIKEEVQLTSKQKEMLQAQLDREAQVRRRLQELDGELEAALGLLDIILAKNPSGLTQYIPVLVDSFLPLLKSPLAAPRIKNPFLSLAACVMPSRLKALGTLVSHVTLRLLKPECVLDKSWCQEELSVAVKRAVMLLHTHTITSRVGKGEPGAAPLSAPAFSLVFPFLKMVLTEMPHHSEEEEEWMAQILQILTVQAQLRASPNTPPGRVDENGPELLPRVAMLRLLTWVIGTGSPRLQVLASDTLTTLCASSSGDDGCAFAEQEEVDVLLCALQSPCASVRETVLRGLMELHMVLPAPDTDEKNGLNLLRRLWVVKFDKEEEIRKLAERLWSMMGLDLQPDLCSLLIDDVIYHEAAVRQAGAEALSQAVARYQRQAAEVMGRLMEIYQEKLYRPPPVLDALGRVISESPPDQWEARCGLALALNKLSQYLDSSQVKPLFQFFVPDALNDRHPDVRKCMLDAALATLNTHGKENVNSLLPVFEEFLKNAPNDASYDAVRQSVVVLMGSLAKHLDKSDPKVKPIVAKLIAALSTPSQQVQESVASCLPPLVPAIKEDAGGMIQRLMQQLLESDKYAERKGAAYGLAGLVKGLGILSLKQQEMMAALTDAIQDKKNFRRREGALFAFEMLCTMLGKLFEPYVVHVLPHLLLCFGDGNQYVREAADDCAKAVMSNLSAHGVKLVLPSLLAALEEESWRTKAGSVELLGAMAYCAPKQLSSCLPNIVPKLTEVLTDSHVKVQKAGQQALRQIGSVIRNPEILAIAPVLLDALTDPSRKTQKCLQTLLDTKFVHFIDAPSLALIMPIVQRAFQDRSTDTRKMAAQIIGNMYSLTDQKDLAPYLPSVTPGLKASLLDPVPEVRTVSAKALGAMVKGMGESCFEDLLPWLMETLTYEQSSVDRSGAAQGLAEVMAGLGVEKLEKLMPEIVATASKVDIAPHVRDGYIMMFNYLPITFGDKFTPYVGPIIPCILKALADENEFVRDTALRAGQRVISMYAETAIALLLPQLEQGLFDDLWRIRFSSVQLLGDLLFHISGVTGKMTTETASEDDNFGTAQSNKAIITALGVERRNRVLAGLYMGRSDTQLVVRQASLHVWKIVVSNTPRTLREILPTLFGLLLGFLASTCADKRTIAARTLGDLVRKLGEKILPEIIPILEEGLRSQKSDERQGVCIGLSEIMKSTSRDAVLYFSESLVPTARKALCDPLEEVREAAAKTFEQLHSTIGHQALEDILPFLLKQLDDEEVSEFALDGLKQVMAIKSRVVLPYLVPKLTTPPVNTRVLAFLSSVAGDALTRHLGVILPAVMLALKEKLGTPDEQLEMANCQAVILSVEDDTGHRIIIEDLLEATRSPEVGMRQAAAIILNIYCSRSKADYTSHLRSLVSGLIRLFNDSSPVVLEESWDALNAITKKLDAGNQLALIEELHKEIRLIGNESKGEHVPGFCLPKKGVTSILPVLREGVLTGSPEQKEEAAKALGLVIRLTSADALRPSVVSITGPLIRILGDRFSWNVKAALLETLSLLLAKVGIALKPFLPQLQTTFTKALQDSNRGVRLKAADALGKLISIHIKVDPLFTELLNGIRAMEDPGVRDTMLQALRFVIQGAGAKVDAVIRKNIVSLLLSMLGHDEDNTRISSAGCLGELCAFLTEEELSAVLQQCLLADVSGIDWMVRHGRSLALSVAVNVAPGRLCAGRYSSDVQEMILSSATADRIPIAVSGVRGMGFLMRHHIETGGGQLPAKLSSLFVKCLQNPSSDIRLVAEKMIWWANKDPLPPLDPQAIKPILKALLDNTKDKNTVVRAYSDQAIVNLLKMRQGEEVFQSLSKILDVASLEVLNEVNRRSLKKLASQADSTEQVDDTILT

SEQ ID NO: 670 - protein, 2432 aa, Homo sapiens; identical to SEQ ID NO: 668

SEQ ID NO: 671 - protein, 2671 aa, Homo sapiens
MAADTQVSETLKRFAGKVTTASVKERREILSELGKCVAGKDLPEGAVKGLCKLFCLTLHRYRDAASRRALQAAIQQLAEAQPEATAKNLLHSLQSSGIGSKAGVPSKSSGSAALLALTWTCLLVRIVFPSRAKRQGDIWNKLVEVQCLLLLEVLGGSHKHAVDGAVKKLTKLWKENPGLVEQYLSAILSLEPNQNYAGMLGLLVQFCTSHKEMDVVSQHKSALLDFYMKNILMSKVKPPKYLLDSCAPLLRYLSHSEFKDLILPTIQKSLLRSPENVIETISSLLASVTLDLSQYAMDIVKGLAGHLKSNSPRLMDEAVLALRNLARQCSDSSAMESLTKHLFAILGGSEGKLTVVAQKMSVLSGIGSVSHHVVSGPSSQVLNGIVAELFIPFLQQEVHEGTLVHAVSVLALWCNRFTMEVPKKLTEWFKKAFSLKTSTSAVRHAYLQCMLASYRGDTLLQALDLLPLLIQTVEKAASQSTQVPTITEGVAAALLLLKLSVADSQAEAKLSSFWQLIVDEKKQVFTSEKFLVMASEDALCTVLHLTERLFLDHPHRLTGNKVQQYHRALVAVLLSRTWHVRRQAQQTVRKLLSSLGGFKLAHGLLEELKTVLSSHKVLPLEALVTDAGEVTEAGKAYVPPRVLQEALCVISGVPGLKGDVTDTEQLAQEMLIISHHPSLVAVQSGLWPALLARMKIDPEAFITRHLDQIIPRMTTQSPLNQSSMNAMGSLSVLSPDRVLPQLISTITASVQNPALRLVTREEFAIMQTPAGELYDKSIIQSAQQDSIKKANMKRENKAYSFKEQIIELELKEEIKKKKGIKEEVQLTSKQKEMLQAQLDREAQVRRRLQELDGELEAALGLLDIILAKNPSGLTQYIPVLVDSFLPLLKSPLAAPRIKNPFLSLAACVMPSRLKALGTLVSHVTLRLLKPECVLDKSWCQEELSVAVKRAVMLLHTHTITSRVGKGEPGAAPLSAPAFSLVFPFLKMVLTEMPHHSEEEEEWMAQILQILTVQAQLRASPNTPPGRVDENGPELLPRVAMLRLLTWVIGTGSPRLQVLASDTLTTLCASSSGDDGCAFAEQEEVDVLLCALQSPCASVRETVLRGLMELHMVLPAPDTDEKNGLNLLRRLWVVKFDKEEEIRKLAERLWSMMGLDLQPDLCSLLIDDVIYHEAAVRQAGAEALSQAVARYQRQAAEVMGRLMEIYQEKLYRPPPVLDALGRVISESPPDQWEARCGLALALNKLSQYLDSSQVKPLFQFFVPDALNDRHPDVRKCMLDAALATLNTHGKENVNSLLPVFEEFLKNAPNDASYDAVRQSVVVLMGSLAKHLDKSDPKVKPIVAKLIAALSTPSQQVQESVASCLPPLVPAIKEDAGGMIQRLMQQLLESDKYAERKGAAYGLAGLVKGLGILSLKQQEMMAALTDAIQDKKNFRRREGALFAFEMLCTMLGKLFEPYVVHVLPHLLLCFGDGNQYVREAADDCAKAVMSNLSAHGVKLVLPSLLAALEEESWRTKAGSVELLGAMAYCAPKQLSSCLPNIVPKLTEVLTDSHVKVQKAGQQALRQIGSVIRNPEILAIAPVLLDALTDPSRKTQKCLQTLLDTKFVHFIDAPSLALIMPIVQRAFQDRSTDTRKMAAQIIGNMYSLTDQKDLAPYLPSVTPGLKASLLDPVPEVRTVSAKALGAMVKGMGESCFEDLLPWLMETLTYEQSSVDRSGAAQGLAEVMAGLGVEKLEKLMPEIVATASKVDIAPHVRDGYIMMFNYLPITFGDKFTPYVGPIIPCILKALADENEFVRDTALRAGQRVISMYAETAIALLLPQLEQGLFDDLWRIRFSSVQLLGDLLFHISGVTGKMTTETASEDDNFGTAQSNKAIITALGVERRNRVLAGLYMGRSDTQLVVRQASLHVWKIVVSNTPRTLREILPTLFGLLLGFLASTCADKRTIAARTLGDLVRKLGEKILPEIIPILEEGLRSQKSDERQGVCIGLSEIMKSTSRDAVLYFSESLVPTARKALCDPLEEVREAAAKTFEQLHSTIGHQALEDILPFLLKQLDDEEVSEFALDGLKQVMAIKSRVVLPYLVPKLTTPPVNTRVLAFLSSVAGDALTRHLGVILPAVMLALKEKLGTPDEQLEMANCQAVILSVEDDTGHRIIIEYLLEATRSPEVGMRQAAAIILNIYCSRSKADYTSHLRSLVSGLIRLFNDSSPVVLEESWDALNAITKKLDAGNQLALIEELHKEIRLIGNESKGEHVPGFCLPKKGVTSILPVLREGVLTGSPEQKEEAAKALGLVIRLTSADALRPSVVSITGPLIRILGDRFSWNVKAALLETLSLLLAKVGIALKPFLPQLQTTFTKALQDSNRGVRLKAADALGKLISIHIKVDPLFTELLNGIRAMEDPGVRDTMLQALRFVIQGAGAKVDAVIRKNIVSLLLSMLGHDEDNTRISSAGCLGELCAFLTEEELSAVLQQCLLADVSGIDWMVRHGRSLALSVAVNVAPGRLCAGRYSSDVQEMILSSATADRIPIAVSGVRGMGFLMRHHIETGGGQLPAKLSSLFVKCLQNPSSDIRLVAEKMIWWANKDPLPPLDPQAIKPILKALLDNTKDKNTVVRAYSDQAIVNLLKMRQGEEVFQSLSKILDVASLEVLNEVNRRSLKKLASQADSTEQVDDTILT

SEQ ID NO: 672 - protein, 2432 aa, Homo sapiens; identical to SEQ ID NO: 668

SEQ ID NO: 673 - protein, 495 aa, Homo sapiens [sequence omitted]

SEQ ID NO: 674 - protein, 495 aa, Homo sapiens
MPMGSLQPLATLYLLGMLVASCLGRLSWYDPDFQARLTRSNSKCQGQLEVYLKDGWHMVCSQSWGRSSKQWEDPSQASKVCQRLNCGVPLSLGPFLVTYTPQSSIICYGQLGSFSNCSHSRNDMCHSLGLTCLEPQKTTPPTTRPPPTTTPEPTAPPRLQLVAQSGGQHCAGVVEFYSGSLGGTISYEAQDKTQDLENFLCNNLQCGSFLKHLPETEAGRAQDPGEPREHQPLPIQWKIQNSSCTSLEHCFRKIKPQKSGRVLALLCSGFQPKVQSRLVGGSSICEGTVEVRQGAQWAALCDSSSARSSLRWEEVCREQQCGSVNSYRVLDAGDPTSRGLFCPHQKLSQCHELWERNSYCKKVFVTCQDPNPAGLAAGTVASIILALVLLVVLLVVCGPLAYKKLVKKFRQKKQRQWIGPTGMNQNMSFHRNHTATVRSHAENPTASHVDNEYSQPPRNSRLSAYPALEGVLHRSSMQPDNSSDSDYDLHGAQRL

SEQ ID NO: 675 - protein, 1960 aa, Homo sapiens
MAQQAADKYLYVDKNFINNPLAQADWAAKKLVWVPSDKSGFEPASLKEEVGEEAIVELVENGKKVKVNKDDIQKMNPPKFSKVEDMAELTCLNEASVLHNLKERYYSGLIYTYSGLFCVVINPYKNLPIYSEEIVEMYKGKKRHEMPPHIYAITDTAYRSMMQDREDQSILCTGESGAGKTENTKKVIQYLAYVASSHKSKKDQGELERQLLQANPILEAFGNAKTVKNDNSSRFGKFIRINFDVNGYIVGANIETYLLEKSRAIRQAKEERTFHIFYYLLSGAGEHLKTDLLLEPYNKYRFLSNGHVTIPGQQDKDMFQETMEAMRIMGIPEEEQMGLLRVISGVLQLGNIVFKKERNTDQASMPDNTAAQKVSHLLGINVTDFTRGILTPRIKVGRDYVQKAQTKEQADFAIEALAKATYERMFRWLVLRINKALDKTKRQGASFIGILDIAGFEIFDLNSFEQLCINYTNEKLQQLFNHTMFILEQEEYQREGIEWNFIDFGLDLQPCIDLIEKPAGPPGILALLDEECWFPKATDKSFVEKVMQEQGTHPKFQKPKQLKDKADFCIIHYAGKVDYKADEWLMKNMDPLNDNIATLLHQSSDKFVSELWKDVDRIIGLDQVAGMSETALPGAFKTRKGMFRTVGQLYKEQLAKLMATLRNTNPNFVRCIIPNHEKKAGKLDPHLVLDQLRCNGVLEGIRICRQGFPNRVVFQEFRQRYEILTPNSIPKGFMDGKQACVLMIKALELDSNLYRIGQSKVFFRAGVLAHLEEERDLKITDVIIGFQACCRGYLARKAFAKRQQQLTAMKVLQRNCAAYLKLRNWQWWRLFTKVKPLLQVSRQEEEMMAKEEELVKVREKQLAAENRLTEMETLQSQLMAEKLQLQEQLQAETELCAEAEELRARLTAKKQELEEICHDLEARVEEEEERCQHLQAEKKKMQQNIQELEEQLEEEESARQKLQLEKVTTEAKLKKLEEEQIILEDQNCKLAKEKKLLEDRIAEFTTNLTEEEEKSKSLAKLKNKHEAMITDLEERLRREEKQRQELEKTRRKLEGDSTDLSDQIAELQAQIAELKMQLAKKEEELQAALARVEEEAAQKNMALKKIRELESQISELQEDLESERASRNKAEKQKRDLGEELEALKTELEDTLDSTAAQQELRSKREQEVNILKKTLEEEAKTHEAQIQEMRQKHSQAVEELAEQLEQTKRVKANLEKAKQTLENERGELANEVKVLLQGKGDSEHKRKKVEAQLQELQVKFNEGERVRTELADKVTKLQVELDNVTGLLSQSDSKSSKLTKDFSALESQLQDTQELLQEENRQKLSLSTKLKQVEDEKNSFREQLEEEEEAKHNLEKQIATLHAQVADMKKKMEDSVGCLETAEEVKRKLQKDLEGLSQRHEEKVAAYDKLEKTKTRLQQELDDLLVDLDHQRQSACNLEKKQKKFDQLLAEEKTISAKYAEERDRAEAEAREKETKALSLARALEEAMEQKAELERLNKQFRTEMEDLMSSKDDVGKSVHELEKSKRALEQQVEEMKTQLEELEDELQATEDAKLRLEVNLQAMKAQFERDLQGRDEQSEEKKKQLVRQVREMEAELEDERKQRSMAVAARKKLEMDLKDLEAHIDSANKNRDEAIKQLRKLQAQMKDCMRELDDTRASREEILAQAKENEKKLKSMEAEMIQLQEELAAAERAKRQAQQERDELADEIANSSGKGALALEEKRRLEARIAQLEEELEEEQGNTELINDRLKKANLQIDQINTDLNLERSHAQKNENARQQLERQNKELKVKLQEMEGTVKSKYKASITALEAKIAQLEEQLDNETKERQAACKQVRRTEKKLKDVLLQVDDERRNAEQYKDQADKASTRLKQLKRQLEEAEEEAQRANASRRKLQRELEDATETADAMNREVSSLKNKLRRGDLPFVVPRRMARKGAGDGSDEEVDGKADGAEAKPAE

SEQ ID NO: 676 - protein, 1960 aa, Homo sapiens; identical to SEQ ID NO: 675

SEQ ID NO: 677 - protein, 1960 aa, Homo sapiens; identical to SEQ ID NO: 675

SEQ ID NO: 678 - protein, 1960 aa, Homo sapiens; identical to SEQ ID NO: 675

SEQ ID NO: 679 - protein, 267 aa, Homo sapiens
MTLGRRLACLFLACVLPALLLGGTALASEIVGGRRARPHAWPFMVSLQLRGGHFCGATLIAPNFVMSAAHCVANVNVRAVRVVLGAHNLSRREPTRQVFAVQRIFENGYDPVNLLNDIVILQLNGSATINANVQVAQLPAQGRRLGNGVQCLAMGWGLLGRNRGIASVLQELNVTVVTSLCRRSNVCTLVRGRQAGVCFGDSGSPLVCNGLIHGIASFVRGGCASGLYPDAFAPVAQFVNWIDSIIQRSEDNPCPHPRDPDPASRTH

SEQ ID NO: 680 - protein, 267 aa, Homo sapiens; identical to SEQ ID NO: 679

SEQ ID NO: 681 - protein, 535 aa, Homo sapiens
MASLSLAPVNIFKAGADEERAETARLTSFIGAIAIGDLVKSTLGPKGMDKILLSSGRDASLMVTNDGATILKNIGVDNPAAKVLVDMSRVQDDEVGDGTTSVTVLAAELLREAESLIAKKIHPQTIIAGWREATKAAREALLSSAVDHGSDEVKFRQDLMNIAGTTLSSKLLTHHKDHFTKLAVEAVLRLKGSGNLEAIHIIKKLGGSLADSYLDEGFLLDKKIGVNQPKRIENAKILIANTGMDTDKIKIFGSRVRVDSTAKVAEIEHAEKEKMKEKVERILKHGINCFINRQLIYNYPEQLFGAAGVMAIEHADFAGVERLALVTGGEIASTFDHPELVKLGSCKLIEEVMIGEDKLIHFSGVALGEACTIVLRGATQQILDEAERSLHDALCVLAQTVKDSRTVYGGGCSEMLMAHAVTQLANRTPGKEAVAMESYAKALRMLPTIIADNAGYDSADLVAQLRAAHSEGNTTAGLDMREGTIGDMAILGITESFQVKRQVLLSAAEAAEVILRVDNIIKAAPRKRVPDHHPC

SEQ ID NO: 682 - protein, 535 aa, Homo sapiens; identical to SEQ ID NO: 681

SEQ ID NO: 683 - protein, 488 aa, Homo sapiens
MDKILLSSGRDASLMVTNDGATILKNIGVDNPAAKVLVDMSRVQDDEVGDGTTSVTVLAAELLREAESLIAKKIHPQTIIAGWREATKAAREALLSSAVDHGSDEVKFRQDLMNIAGTTLSSKLLTHHKDHFTKLAVEAVLRLKGSGNLEAIHIIKKLGGSLADSYLDEGFLLDKKIGVNQPKRIENAKILIANTGMDTDKIKIFGSRVRVDSTAKVAEIEHAEKEKMKEKVERILKHGINCFINRQLIYNYPEQLFGAAGVMAIEHADFAGVERLALVTGGEIASTFDHPELVKLGSCKLIEEVMIGEDKLIHFSGVALGEACTIVLRGATQQILDEAERSLHDALCVLAQTVKDSRTVYGGGCSEMLMAHAVTQLANRTPGKEAVAMESYAKALRMLPTIIADNAGYDSADLVAQLRAAHSEGNTTAGLDMREGTIGDMAILGITESFQVKRQVLLSAAEAAEVILRVDNIIKAAPRKRVPDHHPC

SEQ ID NO: 684 - DNA, 1822 bp, Homo sapiens
agcccggtactcttccggccggcaggccgccgcaccgccgcggccgcgccccaccggctgctcgtggccgagccgcccctggcccctgacccttgacctgactcccagcccgggccccgcgccccaagcggcgaccccgcccgcgcagtccccggaagcgcgcccgcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcgtctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaacttcctgt

SEQ ID NO: 685 - DNA, 1927 bp, Homo sapiens
gatgagctgtgagtgcgcgcgcgtgcgcggggccgcgacctgtgccggctcgagcccgctgggcactcggaggcgcgcacgtcgttccccgccctcccgccgccgcccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcgtctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaacttcctgt

SEQ ID NO: 686 - DNA, 1944 bp, Homo sapiens
tgtgcctccctgcaccccatggccctgagaactctcacacccccaccacaggcacagaaagcaccttactgggaaggccgctgtgtggactatggagtgcggggctgagccggtgggaggttgcagcagggaggctgcagcactgggctggtccagtgctcccactgtggccccagctgaggcaggaagtagagactgaggtgggggaaggaaacagcaaaggcccctgaaaggcagtccggcttagtgcctaaacgcatgtggctgtggagctggaagccggggatgcatcctggtctgagtgctttgctaattgtgtgaccggagcagttccctcccttaacctctctgtgcatcaatagttcctgccttaagggctgttgtgaggagtaaatgagttaatatttgctaatattagaataacgtgtggcacatggtaaactctgtttaagggtctgctgtagtcaacgtcatctgtgtgccaccgtgtgctgtgagcataatgccccctggctctctgttctgatcatccccaactccagggcttcctgaaaccagagctgctaggcagtgaattcacccaccttgagttcccccgcagagttctgcccaaggagctggggcagaggatgttgtaccgggaccagaacatgaccggctggctcgggtgatggccaccattggggtgacccgaggcttgggagaccacagccttaaggtctgcagttccaccctgcccatcaagccctttctctcctgcttccctgaggtacgagtgtatgacctgacacaatatgagcactgcccagatgatgtgctagtcctgggaacagatggcctgtgggatgtcactactgactgtgaggtagctgccactgtggacagggtgctgtcggcctatgagcctaatgaccacagcagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacaccagcactttatacacttctggctcacaggaaagtgtctgcagtaggggacccagagtcccaggcccctggagttgttttcggcaggggccttgtctctcactgcatttggtcaggggggcatgaataaaggctacaggctccaacgtgtgtggcagctttcggtctttc

SEQ ID NO: 687 - DNA, 582 bp, Homo sapiens
atggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctggttgccttgtcttgtga

SEQ ID NO: 688 - DNA, 1667 bp, Homo sapiens
ttcagctacccgccttcgtctccgagtttgcgactcgcggaccggcgtccccggcgcgaagaggctggactcggattcgttgcagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcgtctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaa

SEQ ID NO: 689 - DNA, 582 bp, Homo sapiens
atggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctga

SEQ ID NO: 690 - DNA, 1260 bp, Homo sapiens
ccggcaccggccgcgcagctggaggcggcggagcggaagggcaaggtgaactaatggagtgggtggaggagttggaagaaatcccagcgtcagtcaccgggatagaattcccaaggaaccctctttttggaggatggtttccatttctggaggcgatctgccgacaggccttgacttcatctcagctccagagcccgccctctcttcctgcagcctgggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacaccagcactttatacacttctggctcacaggaaagtgtctgcagtaggggacccagagtcccaggcccctggagttgttttcggcaggggccttgtctctcactgcatttggtcaggggggcatgaataaaggctacaggctccaacgtgtgtggcagctttcggtctttc

SEQ ID NO: 691 - DNA, 3235 bp, Homo sapiens
cggctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 692 - DNA, 3371 bp, Homo sapiens
gctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgctgcctccatctagtacaaaacctccagctttgagtcattcagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaaggcacatacctaactgatgagacccacagagaagtaaaatttacttctctctgagaaggagagatgagagaaaggtttgcttttatcattaaaaggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 693 - DNA, 3278 bp, Homo sapiens
gctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgctgcctccatctagtacaaaacctccagctttgagtcattcagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 694 - DNA, 3281 bp, Homo sapiens
gctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaaggcacatacctaactgatgagacccacagagaagtaaaatttacttctctctgagaaggagagatgagagaaaggtttgcttttatcattaaaaggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 695 - DNA, 3199 bp, Homo sapiens
cggctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttcatgatgatgt

SEQ ID NO: 696 - DNA, 2124 bp, Homo sapiens
gaattcggggataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaaggcacatacctaactgatgagacccacagagaagtaaaatttacttctctctgagaaggagagatgagagaaaggtttgcttttatcattaaaaggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagtaaagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgcccgaattc

SEQ ID NO: 697 - DNA, 3191 bp, Homo sapiens
gctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 698 - DNA, 3196 bp, Homo sapiens
gctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 699 - DNA, 3126 bp, Homo sapiens
cggctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggtcctaggcctacttacaagcctccagtctcaaattatccaggatatcctaaacctgaggaaggaatacttgacagtttggatgtttgggtcattgctgtgattgttattgccataggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 700 - DNA, 3328 bp, Homo sapiens
cggctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaaggcacatacctaactgatgagacccacagagaagtaaaatttacttctctctgagaaggagagatgagagaaaggtttgcttttatcattaaaaggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 701 - DNA, 3329 bp, Homo sapiens
gctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgctgcctccatctagtacaaaacctccagctttgagtcattcagtgtcgacttcttccactacaaaatctccagcgtccagtgcctcaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaaggcacatacctaactgatgagacccacagagaagtaaaatttacttctctctgagaaggagagatgagagaaaggtttgcttttatcattaaaaggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 702 - DNA, 3236 bp, Homo sapiens
gctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgctgcctccatctagtacaaaacctccagctttgagtcattcagtgtcgacttcttccactacaaaatctccagcgtccagtgcctcaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 703 - DNA, 3284 bp, Homo sapiens
gctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaaggcacatacctaactgatgagacccacagagaagtaaaatttacttctctctgagaaggagagatgagagaaaggtttgcttttatcattaaaaggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 704 - DNA, 3146 bp, Homo sapiens
gctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 705 - DNA, 3239 bp, Homo sapiens
gctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaaggcacatacctaactgatgagacccacagagaagtaaaatttacttctctctgagaaggagagatgagagaaaggtttgcttttatcattaaaaggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 706 - DNA, 5559 bp, Homo sapiens
ctcagtcagtcgcagccacctccccctgcgctggacttggaggaagggggtggagaatgagaggacgctctccgttctccgccccgcctccccgccccacgtgacatcggtacgtgggagcaacaccgctggatgccccctccctactaaatggttaaaacaatcatcataactcttaaggcccttttatggctgtttcttagcgaaacctcacaacatgcctatggggtgggaattgatgttccattccacagctgactccactgaagcccatgaggaagaaattggcccaaatcacagtcccctctgattacagaacagaaaaagtcagctaaaatctcaggatcacttttttcaggtgatgggaggatttcagaagttctgtggacacctgaaattgggcacaaaatcaggtgtttcatgccagtgggcattttccaggtagagggatcatatttctctcgagagtctaaaagtgtgttgaacaagcccactctttacagatggggagactgagcctggggacagggagtggcctgctcagaaaagactcagaaattaaatccagtccagtgggttgatatttacccaaatttccagcctggggagattgatgcacccaagagaagaacccagaaatgaaactttgttcttttatgctaaaaaataaaattccccagagtgcttacaatctctcctcccactccctttttcctgccctaaataaataatggcgaatgagcacccagccagggatgtgtctgatcaaacaatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaaggtacaggggagtgttggtggccatctgggtcaatgtagggagggcgagggtggtctgggcttggtggcaccgactgacactccttcctcatagagtcatgcaagggccgctgcactgagggcttcaacgtggacaagaagtgccagtgtgacgagctctgctcttactaccagagctgctgcacagactatacggctgagtgcaagccccaaggtgtgttcagagcccaggtgggtgggctggggtgccccctgctgctggagactcactaccatccactctctgcagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgaggtgaatccagggcaggtactggggatgcgggtctgccccaggagcgtccctgctctcacaccatctcctccactctagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaaggtgccaggggctgtgggccagggtagaaagcatctagggagggtttgagagctattgctcccagggacagggtggacagggaagctggacccagggccctgcaggacctggtgggagctctgtgagcacagggcagccccaagactccaggtcctgggcagtgaacctggacctgggaacggctgccttagggcaagggactctgcctctgtgcccagccagcggcctccataccccttttcactttccccacctcttagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaagggtactcagggggtggtgggagactgagcaggcagtggagcagtcttggattcctttcacacttcactggggacaggcctcagcatgtgcccacccctgacccccacctcatgctgggagatcctaacttcaacagcctctgggatctccagtcttgccctggcccagccctcctaatgcccaccaccccgctcctcagggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctggtatggagagagggcaagtcttgcttctccctcaaaagggctgaaaccccttggtattggtagagccaggccggctggagggggctgtggttgtggagctatcgatcaaagtctgtttgctcaggccagactttgcttctgttgaccttttggggaaagctcagctctacctggaccccacaccttggactttgcctagcacagctgagagcacagccagcagagggaggggctgtggctgaggagtttagggggcctgggggggtggggtcgagacaccagtgatatggtggagggaaagcacagggggaagggaattggactgagagtcaaaggcctggctctgccattcgctgctgtgtgtctttgggcaaggtgcagcagatgaactctaatggccccgctggaaggggcaagattcggacccccaagacctctcattcaccccttccctgccacagctggtaccagacagccccagttcattagccgggactggcacggtgtgccagggcaagtggacgcagccatggctggccgcatctacatctcaggcatggcaccccgcccctccttggccaagaaacaaaggtttaggcatcgcaaccgcaaaggctaccgttcacaacgaggccacagccgtggccgcaaccagaactcccgccggccatcccgcgccacgtggctgtccttgttctccagtgaggagagcaacttgggagccaacaactatgatgactacaggatggactggcttgtgcctgccacctgtgaacccatccagagtgtcttcttcttctctggaggtaggagccgctgccacccctgaagctggtctagcttgggttttccttgctgtccctggtgcacaagggctgaacgcagcctgcaagtagtgaccacagaaagccaggccagaagtccttagctgcatcatggatgttcactttcccttctgggagagaccctagacttctcaagggaagagtgggcagggccaggctgggcctcacgcatcctctgctttcctctcttccagacaagtactaccgagtcaatcttcgcacacggcgagtggacactgtggaccctccctacccacgctccatcgctcagtactggctgggctgcccagctcctggccatctgtaggagtcagagcccacatggccgggccctctgtagctccctcctcccatctccttcccccagcccaataaaggtcccttagccccgagtttaaaattattgttctgactggggtagacacatccctgtctgggtaaaggagaggaagctggactgtcagaatgggttggtgagggggacagagaagggacagagaagggcctcgccgtgtccaacccatgttgggctcaggacctctctgtgctcaggacctctctgtgaaccgaagtttggggctggggaaggcctcctgagagctacccttcctcttgagctaagcagcccccagcaacccaccagcagctaagcagacacttgaactcctctgatgatgacaaagttaccaggccagcctccgtgggtgaggcttgctttgccccttggagttgactagggtcttggaggagagagaaggggcaagagttggtggggttctggctcagcttttttgtccatcctgatctgaaatcctagtagctctgactcctgagcacttggggaaccagtcactgtgcttccccaaacccacccctagggtgagcctttcttgaggtctctgtctagggtctaggatggggagcagcaagaccaggagagatagtgaagggcagaaactgaaaggaaattcaaaagcacacacttcttgtggaaaagtggcccaggagcccaggagtttgaagctgcagtgagctattattgtaccactgcactccaacctggggaatagagtgagactctatctctaaaaacagaacaaaataaaaaagggggggaatttttgtctgggcatggtggctcatgcctgtaattccagcactttgggaagccaaggtgggaggattgctggaatcccgaagtttgagaccagcctaggcaatatagcaagacaccatctctacaaaaataaataagttagctgggcaacttatgggtggtgtgtgcctgtagtcccagctatttaggaggctgaggtgggaggattgcttgagcttgggaggttgaggctgcagtgagcagaaatcacaccactgtactccagcctgggcaacagagtgagaaaaagaaaatttaggccaggcacggtggttcatgcctgtagtcccagcactttgggaaaccaaggcgcgtggatcatgaggttaggagttcgagaccagcctggccaacatggtgaaaccccgtctctactaaaaatacaaaaaattagccgggtgtggtggcaggcgcctgtaaccccagctactccggaggaagaggcaggaggtggagttgcttgaactcgggaggtggaggttgcagtgagccaagatcacgccactgcactccagcctgggtgacaaagcaagactccatcttgaaaaaaaaagaaaaaagaaaaaaattttcaaaatttaagaaaaagtggctcagaatatatccaaggaa

SEQ ID NO: 707 - DNA, 2023 bp, Homo sapiens
caatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaaggggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctgctggtaccagacagccccagttcattagccgggactggcacggtgtgccagggcaagtggacgcagccatggctggccgcatctacatctcaggcatggcaccccgcccctccttggccaagaaacaaaggtttaggcatcgcaaccgcaaaggctaccgttcacaacgaggccacagccgtggccgcaaccagaactcccgccggccatcccgcgccatgtggctgtccttgttctccagtgaggagagcaacttgggagccaacaactatgatgactacaggatggactggcttgtgcctgccacctgtgaacccatccagagtgtcttcttcttctctggagacaagtactaccgagtcaatcttcgcacacggcgagtggacactgtggaccctccctacccacgctccatcgctcagtactggctgggctgcccagctcctggccatctgtaggagtcagagcccacatggccgggccctctgtagctccctcctcccatctccttcccccagcccaataaaggtcccttagccccgagtttaaaa

SEQ ID NO: 708 - DNA, 6039 bp, Homo sapiens
agggtcaagaacccgatagaaaggttgggggaactagtttcccaccttgttaaacacgtcccataaatgtcccttagtcgagctttttttttttttaaccgtcttttaaggtggaaacggcaaaatcctctttcagtgattcccatgtttttttttttttaattcttaattctactgggcctcttgttccaattagaacagtttccgatcgcctagttccttaaaaacctctcactacgttcagaggttgcctcttttttctggatgaatcattttcctgcactttagaggacgtacggatttcgtcactaccccctgaagaggcctttgaggctggttgcctcgttttataattaccgagagctttctctttccagcttttcacttcttcttgtagtcgcgacttggagttttgctaatgtctccctcctttcctaagtgacattgaatccgtagggatgttgatgccatcatcccctctttcccctgcaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggcaagcaaactgacaaaaccaagagtaacatgaaaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatgtaggtattttgtaaaataaccttgaaattgtaaattgacacgtgtttggtcagattgtgtcaagtttaatttgttttgttttcttttttcttttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaataaaaatgtttagctttggtaataacttccaagctgaactccctctagcaagatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtcctggtatatcgtcattccatctgcagctggagctggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctaggttactactctttactttgttcacccattggggggtgcagtttttttaaaatgttgggagatggccattctaactactgttgaatgtctctgttttgggaaggtataacaagaaataaaaaagaatatatatgaagggagagactggttatctcctcccatatggttgtgcttatcctcttatggcttacaaatgaatatttggaggtttgctttcacaatgatttcccatcaacaaatatttttagtaggatttttcctgtttctgttagtccttgcagtactcataaatgttttaagctgagcatactgtaatagtcataagtttaatttcattataataaaaataatcaaacaaaaggactttagaacccaagacaatgagctagttttccctaaagtttgctgaactattaaggaatatgttcttatagcttttgactagaatgagtcatgggaattctaagaagggatggcctagacatttttagctcagttaaattcagcatttaatgcaggtgagttcctgggtcgttttccaactagtctggaacagtctggttctgactcaaactggtataaagcattattttaggttttctctttgccagtttttaagcagttataaccatgtaaatcaagatgtgaggacatctatatgaagtatagtaaagaagtggtgtcagcagatcaatatgtgtgtcctgggtgtgctgctctcttaagtgagactttgtgagactatactttaaatgcattattaccattgcttacattttgggggattttcttcctcctcaaaacttccatttctattgtaatattcttaatgacaatctttttttttttttagcagtgtatgtttgaaacagccaaagatggcgatgaaccaagtgtaaattgatctaagcagcccatgcagtttgtgttgaatcaacaaacagtgtattgttgaagtgaaattattttctgaaatgacttgttagaccagttttgaggacatactcaaaagtagagtaataatggctcctgggatggagaaatatgagatgaacctggaacattctattatggtgccacaaaggaaatctaaaaaaaaaaaaaaaaaaaaaagtggttggctaggagcagtggcacacgcctgtgattccagcactttgggaggccgaagtgggcaggagttcaagaccagcctggccaacatagtgaaaccctgtctctactaaaaatacaaaaattagccgggtgtggtggcgggcgcctgtaatcccagcttttcaagaggctgaggcagaagaatcgcttgaacccgggagatggaggttgcagtgagctgagatcgtgccactgcactccagcctgggcgttgcagtgagactccgtctcaacaacaacaaaaaggtggatacatgtcaaaagggcacaggagccacttgaaggattatacttgctaaatctgtgtcaattatcaaaataaactggtagcaacgttacaactcactgaataagataccatgattccatgttgacttaaaaatggagagaagagaaagctctaacttgaatgtcagctaatttaaggtgaaaggattttatgtgttagaaaaatcaccattttgcaaactagttttcagaatccttaatatatgtcatctcttttattcctcataacagtaataagaaacagttaactgtttcagaaaagagtggggctgcccaaggcaaggcatgttggtaattggtaagctttatagagccaagacctcaacctgattttcttgctttcatgcagttaagccatggtgctcctcttgttatatcacccttttaaacccagagattgatagtattagccatcatttgctgagtgtcatgcactattctaagtgctttacatgtatttgcctaatcagcgccctgtgaagtacatcctgtctccattttgcatataaggataccaaagcacagagttggagggaagatagttatattcccttactttatttatttatttttttgagacagggtctcgcactgtcgcccaggcttgagtgctataagaccttaagtttcccctttcaaagtagtttatagtgtctaaatatcttacataaaagtatatatcaaatagggtggcagtctggaaagatttaaaatccagaatgactggaaggttgggcaactaagatttcttaaattgcagctgttttcaacatagatgtgttgtagagtcttttcggtttcaaaattaaattgactataaatggagtgtgcttaa

SEQ ID NO: 709 - DNA, 7886 bp, Homo sapiens
ccccatccccaccgcctccaggctgccggggctgggccgctgtacgggagccaaggtgcggtgccccgcgtgtggacgagccgaggtgcagcccgcggggccgcagggccggggtggggcggggcgcggcgggagcagatccggtgtttgcggaatcaggaggggcgggccggggcgggccctcggcgctgcaggagctgcccagaaacttttccctgctctcaccgggcgggggagagaagccctctggacagcttctagagtgtgcaggttctcgtatccctcggccaagggtatcctctgcaaacctctgcaaacccagcgcaactacggtcccccggtcagacccaggatggggccagaacggacaggggccgcgccgctgccgctgctgctggtgttagcgctcagtcaaggcattttaaattgttgtttggcctacaatgttggtctcccagaagcaaaaatattttccggtccttcaagtgaacagtttggctatgcagtgcagcagtttataaatccaaaaggcaactggttactggttggttcaccctggagtggctttcctgagaaccgaatgggagatgtgtataaatgtcctgttgacctatccactgccacatgtgaaaaactaaatttgcaaacttcaacaagcattccaaatgttactgagatgaaaaccaacatgagcctcggcttgatcctcaccaggaacatgggaactggaggttttctcacatgtggtcctctgtgggcacagcaatgtgggaatcagtattacacaacgggtgtgtgttctgacatcagtcctgattttcagctctcagccagcttctcacctgcaactcagccctgcccttccctcatagatgttgtggttgtgtgtgatgaatcaaatagtatttatccttgggatgcagtaaagaattttttggaaaaatttgtacaaggcctggatataggccccacaaagacacaggtggggttaattcagtatgccaataatccaagagttgtgtttaacttgaacacatataaaaccaaagaagaaatgattgtagcaacatcccagacatcccaatatggtggggacctcacaaacacattcggagcaattcaatatgcaagaaaatatgcttattcagcagcttctggtgggcgacgaagtgctacgaaagtaatggtagttgtaactgacggtgaatcacatgatggttcaatgttgaaagctgtgattgatcaatgcaaccatgacaatatactgaggtttggcatagcagttcttgggtacttaaacagaaacgcccttgatactaaaaatttaataaaagaaataaaagcaatcgctagtattccaacagaaagatactttttcaatgtgtctgatgaagcagctctactagaaaaggctgggacattaggagaacaaattttcagcattgaaggtactgttcaaggaggagacaactttcagatggaaatgtcacaagtgggattcagtgcagattactcttctcaaaatgatattctgatgctgggtgcagtgggagcttttggctggagtgggaccattgtccagaagacatctcatggccatttgatctttcctaaacaagcctttgaccaaattctgcaggacagaaatcacagttcatatttaggttactctgtggctgcaatttctactggagaaagcactcactttgttgctggtgctcctcgggcaaattataccggccagatagtgctatatagtgtgaatgagaatggcaatatcacggttattcaggctcaccgaggtgaccagattggctcctattttggtagtgtgctgtgttcagttgatgtggataaagacaccattacagacgtgctcttggtaggtgcaccaatgtacatgagtgacctaaagaaagaggaaggaagagtctacctgtttactatcaaagagggcattttgggtcagcaccaatttcttgaaggccccgagggcattgaaaacactcgatttggttcagcaattgcagctctttcagacatcaacatggatggctttaatgatgtgattgttggttcaccactagaaaatcagaattctggagctgtatacatttacaatggtcatcagggcactatccgcacaaagtattcccagaaaatcttgggatccgatggagcctttaggagccatctccagtactttgggaggtccttggatggctatggagatttaaatggggattccatcaccgatgtgtctattggtgcctttggacaagtggttcaactctggtcacaaagtattgctgatgtagctatagaagcttcattcacaccagaaaaaatcactttggtcaacaagaatgctcagataattctcaaactctgcttcagtgcaaagttcagacctactaagcaaaacaatcaagtggccattgtatataacatcacacttgatgcagatggattttcatccagagtaacctccagggggttatttaaagaaaacaatgaaaggtgcctgcagaagaatatggtagtaaatcaagcacagagttgccccgagcacatcatttatatacaggagccctctgatgttgtcaactctttggatttgcgtgtggacatcagtctggaaaaccctggcactagccctgcccttgaagcctattctgagactgccaaggtcttcagtattcctttccacaaagactgtggtgaggacggactttgcatttctgatctagtcctagatgtccgacaaataccagctgctcaagaacaaccctttattgtcagcaaccaaaacaaaaggttaacattttcagtaacgctgaaaaataaaagggaaagtgcatacaacactggaattgttgttgatttttcagaaaacttgttttttgcatcattctccctgccggttgatgggacagaagtaacatgccaggtggctgcatctcagaagtctgttgcctgcgatgtaggctaccctgctttaaagagagaacaacaggtgacttttactattaactttgacttcaatcttcaaaaccttcagaatcaggcgtctctcagtttccaagccttaagtgaaagccaagaagaaaacaaggctgataatttggtcaacctcaaaattcctctcctgtatgatgctgaaattcacttaacaagatctaccaacataaatttttatgaaatctcttcggatgggaatgttccttcaatcgtgcacagttttgaagatgttggtccaaaattcatcttctccctgaaggtaacaacaggaagtgttccagtaagcatggcaactgtaatcatccacatccctcagtataccaaagaaaagaacccactgatgtacctaactggggtgcaaacagacaaggctggtgacatcagttgtaatgcagatatcaatccactgaaaataggacaaacatcttcttctgtatctttcaaaagtgaaaatttcaggcacaccaaagaattgaactgcagaactgcttcctgtagtaatgttacctgctggttgaaagacgttcacatgaaaggagaatactttgttaatgtgactaccagaatttggaacgggactttcgcatcatcaacgttccagacagtacagctaacggcagctgcagaaatcaacacctataaccctgagatatatgtgattgaagataacactgttacgattcccctgatgataatgaaacctgatgagaaagccgaagtaccaacaggagttataataggaagtataattgctggaatccttttgctgttagctctggttgcaattttatggaagctcggcttcttcaaaagaaaatatgaaaagatgaccaaaaatccagatgagattgatgagaccacagagctcagtagctgaaccagcagacctacctgcagtgggaaccggcagcatcccagccagggtttgctgtttgcgtgaatggatttctttttaaatcccatattttttttatcatgtcgtaggtaaactaacctggtattttaagagaaaactgcaggtcagtttggaatgaagaaattgtggggggtgggggaggtgcggggggcaggtagggaaataatagggaaaatacctattttatatgatgggggaaaaaaagtaatctttaaactggctggcccagagtttacattctaatttgcattgtgtcagaaacatgaaatgcttccaagcatgacaacttttaaagaaaaatatgatactctcagattttaagggggaaaactgttctctttaaaatatttgtctttaaacagcaactacagaagtggaagtgcttgatatgtaagtacttccacttgtgtatattttaatgaatattgatgttaacaagaggggaaaacaaaacacaggttttttcaatttatgctgctcatccaaagttgccacagatgatacttccaagtgataattttatttataaactaggtaaaatttgttgttggttccttttagaccacggctgccccttccacaccccatcttgctctaatgatcaaaacatgcttgaataactgagcttagagtatacctcctatatgtccatttaagttaggagagggggcgatatagagactaaggcacaaaattttgtttaaaactcagaatataacatgtaaaatcccatctgctagaagcccatcctgtgccagaggaaggaaaaggaggaaatttcctttctcttttaggaggcacaacagttctcttctaggatttgtttggctgactggcagtaacctagtgaatttctgaaagatgagtaatttctttggcaaccttcctcctcccttactgaaccactctcccacctcctggtggtaccattattatagaagccctctacagcctgactttctctccagcggtccaaagttatcccctcctttacccctcatccaaagttcccactccttcaggacagctgctgtgcattagatattaggggggaaagtcatctgtttaatttacacacttgcatgaattactgtatataaactccttaacttcagggagctattttcatttagtgctaaacaagtaagaaaaataagctcgagtgaatttctaaatgttggaatgttatgggatgtaaacaatgtaaagtaagacatctcaggatttcaccagaagttacagatgaggcactggaagccaccaaattagcaggtgcaccttctgtggctgtcttgtttctgaagtacttaaacttccacaagagtgaatttgacctaggcaagtttgttcaaaaggtagatcctgagatgatttggtcagattgggataaggcccagcaatctgcattttaacaagcaccccagtcactaggatgcagatggaccacactttgagaaacaccacccatttctactttttgcaccttattttctctgttcctgagcccccacattctctaggagaaacttagaggaaaagggcacagacactacatatctaaagctttggacaagtccttgacctctataaacttcagagtcctcattataaaatgggaagactgagctggagttcagcagtgatgcttttagttttaaaagtctatgatctggacttcctataatacaaatacacaatcctccaagaatttgacttggaaaaaaatgtcaaaggaaaacaggttatctgcccatgtgcatatggacaaccttgactaccctggcctggcccgtggtggcagtccagggctatctgtactgtttacagaattactttgtagttgacaacacaaaacaaacaaaaaaggcataaaatgccagcggtttatagaaaaaacagcatggtattctccagttaggtatgccagagtccaattcttttaacagctgtgagaatttgctgcttcattccaacaaaattttatttaaaaaaaaaaaaaaaagactggagaaactagtcattagcttgataaagaatatttaacagctagtggtgctggtgtgtacctgaagctccagctacttgagagactgagacaggaagatcgcttgagcccaggagttcaagtccagcctaagcaacatagcaagaccctgtctcaaaaaaatgactatttaaaaagacaatgtggccaggcacggtggctcacacctgtaatcccaacactttgggaggctgaggccggtggatcacgaggtcaggagtttgagactagcctggccaacatggtgaaaccccatctctaataatataaaaattagctgggcgtagtagcaggtgcctgtaatcccagttactcgggaagctgaggcaggagaatcacttgaacccgggaggcagaggtttcagtgagccgagatcgcgccactgcactccagcctgggtgacagggcaagactctgtctcaaacaaacaaacaaaaaaaaagttagtactgtatatgtaaatactagcttttcaatgtgctatacaaacaattatagcacatccttccttttactctgtctcacctcctttaggtgagtacttccttaaataagtgctaaacatacatatacggaacttgaaagctttggttagccttgccttaggtaatcagcctagtttacactgtttccagggagtagttgaattactataaaccattagccacttgtctctgcaccatttatcacaccaggacagggtctctcaacctgggcgctactgtcatttggggccaggtgattcttccttgcaggggctgtcctgtaccttgtaggacagcagccctgtcctagaaggtatgtttagcagcattcctggcctctagctacccgatgccagagcatgctccccccgcagtcatgacaatcaaaaaatgtctccagacattgtcaaatgcctcctggggggcagtatttctcaagcacttttaagcaaaggtaagtattcatacaagaaatttagggggaaaaaacattgtttaaataaaagctatgtgttcctattcaacaatatttttgctttaaaagtaagtagagggcataaaagatgtcatattcaaatttccatttcataaatggtgtacagacaaggtctatagaatgtggtaaaaacttgactgcaacacaaggcttataaaatagtaagatagtaaaatagcttatgaagaaactacagagatttaaaattgtgcatgactcatttcagcagcaaaataagaactcctaactgaacagaaatttttctacctagcaatgttattcttgtaaaatagttacctattaaaactgtgaagagtaaaactaaagccaatttattatagtcacacaagtgattatactaaaaattattataaaggttataattttataatgtatttacctgtcctgatatatagctataacccaatatatgaaaatctcaaaaattaagacatcatcatacagaaggcaggattccttaaactgagatccctgatccatctttaatatttcaatttgcacacataaaacaatgcccttttgtgtacattcaggcatacccattttaatcaatttgaaaggttaatttaaacctctagaggtgaatgagaaacatgggggaaaagtatgaaataggtgaaaatcttaactatttctttgaactctaaagactgaaactgtagccattatgtaaataaagtttcatatgtacctgtttattttggcagattaagtcaaaatatgaatgtatatattgcataactatgttagaattgtatatattttaaagaaattgtcttggatattttcctttatacataatagataagtcttttttcaaatgtggtgtttgatgtttttgattaaatgtgttttgcctctttccacaaaaactgtaaaaataaatgcatgtttgtacaaaa

SEQ ID NO: 710 - DNA, 6256 bp, Homo sapiens
ttcggagcgagcgcccgagatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagtgtttagaatctccagtggggaagaggaaaagaagcatgactgttagtacttctcaggacccatctttctcaggattaaaccagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggcaagcaaactgacaaaaccaagagtaacatgaaaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatgtaggtattttgtaaaataaccttgaaattgtaaattgacacgtgtttggtcagattgtgtcaagtttaatttgttttgttttcttttttcttttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaataaaaatgtttagctttggtaataacttccaagctgaactccctctagcaagatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtcctggtatatcgtcattccatctgcagctggagctggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctaggttactactctttactttgttcacccattggggggtgcagtttttttaaaatgttgggagatggccattctaactactgttgaatgtctctgttttgggaaggtataacaagaaataaaaaagaatatatatgaagggagagactggttatctcctcccatatggttgtgcttatcctcttatggcttacaaatgaatatttggaggtttgctttcacaatgatttcccatcaacaaatatttttagtaggatttttcctgtttctgttagtccttgcagtactcataaatgttttaagctgagcatactgtaatagtcataagtttaatttcattataataaaaataatcaaacaaaaggactttagaacccaagacaatgagctagttttccctaaagtttgctgaactattaaggaatatgttcttatagcttttgactagaatgagtcatgggaattctaagaagggatggcctagacatttttagctcagttaaattcagcatttaatgcaggtgagttcctgggtcgttttccaactagtctggaacagtctggttctgactcaaactggtataaagcattattttaggttttctctttgccagtttttaagcagttataaccatgtaaatcaagatgtgaggacatctatatgaagtatagtaaagaagtggtgtcagcagatcaatatgtgtgtcctgggtgtgctgctctcttaagtgagactttgtgagactatactttaaatgcattattaccattgcttacattttgggggattttcttcctcctcaaaacttccatttctattgtaatattcttaatgacaatctttttttttttttagcagtgtatgtttgaaacagccaaagatggcgatgaaccaagtgtaaattgatctaagcagcccatgcagtttgtgttgaatcaacaaacagtgtattgttgaagtgaaattattttctgaaatgacttgttagaccagttttgaggacatactcaaaagtagagtaataatggctcctgggatggagaaatatgagatgaacctggaacattctattatggtgccacaaaggaaatctaaaaaaaaaaaaaaaaaaaaaagtggttggctaggagcagtggcacacgcctgtgattccagcactttgggaggccgaagtgggcaggagttcaagaccagcctggccaacatagtgaaaccctgtctctactaaaaatacaaaaattagccgggtgtggtggcgggcgcctgtaatcccagcttttcaagaggctgaggcagaagaatcgcttgaacccgggagatggaggttgcagtgagctgagatcgtgccactgcactccagcctgggcgttgcagtgagactccgtctcaacaacaacaaaaaggtggatacatgtcaaaagggcacaggagccacttgaaggattatacttgctaaatctgtgtcaattatcaaaataaactggtagcaacgttacaactcactgaataagataccatgattccatgttgacttaaaaatggagagaagagaaagctctaacttgaatgtcagctaatttaaggtgaaaggattttatgtgttagaaaaatcaccattttgcaaactagttttcagaatccttaatatatgtcatctcttttattcctcataacagtaataagaaacagttaactgtttcagaaaagagtggggctgcccaaggcaaggcatgttggtaattggtaagctttatagagccaagacctcaacctgattttcttgctttcatgcagttaagccatggtgctcctcttgttatatcacccttttaaacccagagattgatagtattagccatcatttgctgagtgtcatgcactattctaagtgctttacatgtatttgcctaatcagcgccctgtgaagtacatcctgtctccattttgcatataaggataccaaagcacagagttggagggaagatagttatattcccttactttatttatttatttttttgagacagggtctcgcactgtcgcccaggcttgagtgctataagaccttaagtttcccctttcaaagtagtttatagtgtctaaatatcttacataaaagtatatatcaaatagggtggcagtctggaaagatttaaaatccagaatgactggaaggttgggcaactaagatttcttaaattgcagctgttttcaacatagatgtgttgtagagtcttttcggtttcaaaattaaattgactataaatggagtgtgcttaa

SEQ ID NO: 711 - DNA, 4425 bp, Homo sapiens
ttcggagcgagcgcccgagatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagtgtttagaatctccagtggggaagaggaaaagaagcatgactgttagtacttctcaggacccatctttctcaggattaaaccagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatgtaggtattttgtaaaataaccttgaaattgtaaattgacacgtgtttggtcagattgtgtcaagtttaatttgttttgttttcttttttcttttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaataaaaatgtttagctttggtaataacttccaagctgaactccctctagcaagatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtcctggtatatcgtcattccatctgcagctggagctggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctagcagtgtatgtttgaaacagccaaagatggcgatgaaccaagtgtaaattgatctaagcagcccatgcagtttgtgttgaatcaacaaacagtgtattgttgaagtgaaattattttctgaaatgacttgttagaccagttttgaggacatactcaaaagtagagtaataatggctcctgggatggagaaatatgagatgaacctggaacattctattatggtgccacaaaggaaatctaaaaaaaaaaaaaaaaaaaaaagtggttggctaggagcagtggcacacgcctgtgattccagcactttgggaggccgaagtgggcaggagttcaagaccagcctggccaacatagtgaaaccctgtctctactaaaaatacaaaaattagccgggtgtggtggcgggcgcctgtaatcccagcttttcaagaggctgaggcagaagaatcgcttgaacccgggagatggaggttgcagtgagct

SEQ ID NO: 712 - DNA, 6140 bp, Homo sapiens
ttcggagcgagcgcccgagatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccaggtatatgatcagtagaattgaatatgtgcatacaaagaattttatacacagagacattaaaccagataacttcctaatgggtattgggcgtcactgtaataagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatgtaggtattttgtaaaataaccttgaaattgtaaattgacacgtgtttggtcagattgtgtcaagtttaatttgttttgttttcttttttcttttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaataaaaatgtttagctttggtaataacttccaagctgaactccctctagcaagatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtcctggtatatcgtcattccatctgcagctggagctggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctaggttactactctttactttgttcacccattggggggtgcagtttttttaaaatgttgggagatggccattctaactactgttgaatgtctctgttttgggaaggtataacaagaaataaaaaagaatatatatgaagggagagactggttatctcctcccatatggttgtgcttatcctcttatggcttacaaatgaatatttggaggtttgctttcacaatgatttcccatcaacaaatatttttagtaggatttttcctgtttctgttagtccttgcagtactcataaatgttttaagctgagcatactgtaatagtcataagtttaatttcattataataaaaataatcaaacaaaaggactttagaacccaagacaatgagctagttttccctaaagtttgctgaactattaaggaatatgttcttatagcttttgactagaatgagtcatgggaattctaagaagggatggcctagacatttttagctcagttaaattcagcatttaatgcaggtgagttcctgggtcgttttccaactagtctggaacagtctggttctgactcaaactggtataaagcattattttaggttttctctttgccagtttttaagcagttataaccatgtaaatcaagatgtgaggacatctatatgaagtatagtaaagaagtggtgtcagcagatcaatatgtgtgtcctgggtgtgctgctctcttaagtgagactttgtgagactatactttaaatgcattattaccattgcttacattttgggggattttcttcctcctcaaaacttccatttctattgtaatattcttaatgacaatctttttttttttttagcagtgtatgtttgaaacagccaaagatggcgatgaaccaagtgtaaattgatctaagcagcccatgcagtttgtgttgaatcaacaaacagtgtattgttgaagtgaaattattttctgaaatgacttgttagaccagttttgaggacatactcaaaagtagagtaataatggctcctgggatggagaaatatgagatgaacctggaacattctattatggtgccacaaaggaaatctaaaaaaaaaaaaaaaaaaaaaagtggttggctaggagcagtggcacacgcctgtgattccagcactttgggaggccgaagtgggcaggagttcaagaccagcctggccaacatagtgaaaccctgtctctactaaaaatacaaaaattagccgggtgtggtggcgggcgcctgtaatcccagcttttcaagaggctgaggcagaagaatcgcttgaacccgggagatggaggttgcagtgagctgagatcgtgccactgcactccagcctgggcgttgcagtgagactccgtctcaacaacaacaaaaaggtggatacatgtcaaaagggcacaggagccacttgaaggattatacttgctaaatctgtgtcaattatcaaaataaactggtagcaacgttacaactcactgaataagataccatgattccatgttgacttaaaaatggagagaagagaaagctctaacttgaatgtcagctaatttaaggtgaaaggattttatgtgttagaaaaatcaccattttgcaaactagttttcagaatccttaatatatgtcatctcttttattcctcataacagtaataagaaacagttaactgtttcagaaaagagtggggctgcccaaggcaaggcatgttggtaattggtaagctttatagagccaagacctcaacctgattttcttgctttcatgcagttaagccatggtgctcctcttgttatatcacccttttaaacccagagattgatagtattagccatcatttgctgagtgtcatgcactattctaagtgctttacatgtatttgcctaatcagcgccctgtgaagtacatcctgtctccattttgcatataaggataccaaagcacagagttggagggaagatagttatattcccttactttatttatttatttttttgagacagggtctcgcactgtcgcccaggcttgagtgctataagaccttaagtttcccctttcaaagtagtttatagtgtctaaatatcttacataaaagtatatatcaaatagggtggcagtctggaaagatttaaaatccagaatgactggaaggttgggcaactaagatttcttaaattgcagctgttttcaacatagatgtgttgtagagtcttttcggtttcaaaattaaattgactataaatggagtgtgcttaa

SEQ ID NO: 713 - DNA, 6172 bp, Homo sapiens
ttcggagcgagcgcccgagatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggcaagcaaactgacaaaaccaagagtaacatgaaaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatgtaggtattttgtaaaataaccttgaaattgtaaattgacacgtgtttggtcagattgtgtcaagtttaatttgttttgttttcttttttcttttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaataaaaatgtttagctttggtaataacttccaagctgaactccctctagcaagatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtcctggtatatcgtcattccatctgcagctggagctggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctaggttactactctttactttgttcacccattggggggtgcagtttttttaaaatgttgggagatggccattctaactactgttgaatgtctctgttttgggaaggtataacaagaaataaaaaagaatatatatgaagggagagactggttatctcctcccatatggttgtgcttatcctcttatggcttacaaatgaatatttggaggtttgctttcacaatgatttcccatcaacaaatatttttagtaggatttttcctgtttctgttagtccttgcagtactcataaatgttttaagctgagcatactgtaatagtcataagtttaatttcattataataaaaataatcaaacaaaaggactttagaacccaagacaatgagctagttttccctaaagtttgctgaactattaaggaatatgttcttatagcttttgactagaatgagtcatgggaattctaagaagggatggcctagacatttttagctcagttaaattcagcatttaatgcaggtgagttcctgggtcgttttccaactagtctggaacagtctggttctgactcaaactggtataaagcattattttaggttttctctttgccagtttttaagcagttataaccatgtaaatcaagatgtgaggacatctatatgaagtatagtaaagaagtggtgtcagcagatcaatatgtgtgtcctgggtgtgctgctctcttaagtgagactttgtgagactatactttaaatgcattattaccattgcttacattttgggggattttcttcctcctcaaaacttccatttctattgtaatattcttaatgacaatctttttttttttttagcagtgtatgtttgaaacagccaaagatggcgatgaaccaagtgtaaattgatctaagcagcccatgcagtttgtgttgaatcaacaaacagtgtattgttgaagtgaaattattttctgaaatgacttgttagaccagttttgaggacatactcaaaagtagagtaataatggctcctgggatggagaaatatgagatgaacctggaacattctattatggtgccacaaaggaaatctaaaaaaaaaaaaaaaaaaaaaagtggttggctaggagcagtggcacacgcctgtgattccagcactttgggaggccgaagtgggcaggagttcaagaccagcctggccaacatagtgaaaccctgtctctactaaaaatacaaaaattagccgggtgtggtggcgggcgcctgtaatcccagcttttcaagaggctgaggcagaagaatcgcttgaacccgggagatggaggttgcagtgagctgagatcgtgccactgcactccagcctgggcgttgcagtgagactccgtctcaacaacaacaaaaaggtggatacatgtcaaaagggcacaggagccacttgaaggattatacttgctaaatctgtgtcaattatcaaaataaactggtagcaacgttacaactcactgaataagataccatgattccatgttgacttaaaaatggagagaagagaaagctctaacttgaatgtcagctaatttaaggtgaaaggattttatgtgttagaaaaatcaccattttgcaaactagttttcagaatccttaatatatgtcatctcttttattcctcataacagtaataagaaacagttaactgtttcagaaaagagtggggctgcccaaggcaaggcatgttggtaattggtaagctttatagagccaagacctcaacctgattttcttgctttcatgcagttaagccatggtgctcctcttgttatatcacccttttaaacccagagattgatagtattagccatcatttgctgagtgtcatgcactattctaagtgctttacatgtatttgcctaatcagcgccctgtgaagtacatcctgtctccattttgcatataaggataccaaagcacagagttggagggaagatagttatattcccttactttatttatttatttttttgagacagggtctcgcactgtcgcccaggcttgagtgctataagaccttaagtttcccctttcaaagtagtttatagtgtctaaatatcttacataaaagtatatatcaaatagggtggcagtctggaaagatttaaaatccagaatgactggaaggttgggcaactaagatttcttaaattgcagctgttttcaacatagatgtgttgtagagtcttttcggtttcaaaattaaattgactataaatggagtgtgcttaa

SEQ ID NO: 714 - DNA, 6176 bp, Homo sapiens
ttcggagcgagcgcccgagatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggcaagcaaactgacaaaaccaagagtaacatgaaaggttagtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatgtaggtattttgtaaaataaccttgaaattgtaaattgacacgtgtttggtcagattgtgtcaagtttaatttgttttgttttcttttttcttttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaataaaaatgtttagctttggtaataacttccaagctgaactccctctagcaagatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtcctggtatatcgtcattccatctgcagctggagctggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctaggttactactctttactttgttcacccattggggggtgcagtttttttaaaatgttgggagatggccattctaactactgttgaatgtctctgttttgggaaggtataacaagaaataaaaaagaatatatatgaagggagagactggttatctcctcccatatggttgtgcttatcctcttatggcttacaaatgaatatttggaggtttgctttcacaatgatttcccatcaacaaatatttttagtaggatttttcctgtttctgttagtccttgcagtactcataaatgttttaagctgagcatactgtaatagtcataagtttaatttcattataataaaaataatcaaacaaaaggactttagaacccaagacaatgagctagttttccctaaagtttgctgaactattaaggaatatgttcttatagcttttgactagaatgagtcatgggaattctaagaagggatggcctagacatttttagctcagttaaattcagcatttaatgcaggtgagttcctgggtcgttttccaactagtctggaacagtctggttctgactcaaactggtataaagcattattttaggttttctctttgccagtttttaagcagttataaccatgtaaatcaagatgtgaggacatctatatgaagtatagtaaagaagtggtgtcagcagatcaatatgtgtgtcctgggtgtgctgctctcttaagtgagactttgtgagactatactttaaatgcattattaccattgcttacattttgggggattttcttcctcctcaaaacttccatttctattgtaatattcttaatgacaatctttttttttttttagcagtgtatgtttgaaacagccaaagatggcgatgaaccaagtgtaaattgatctaagcagcccatgcagtttgtgttgaatcaacaaacagtgtattgttgaagtgaaattattttctgaaatgacttgttagaccagttttgaggacatactcaaaagtagagtaataatggctcctgggatggagaaatatgagatgaacctggaacattctattatggtgccacaaaggaaatctaaaaaaaaaaaaaaaaaaaaaagtggttggctaggagcagtggcacacgcctgtgattccagcactttgggaggccgaagtgggcaggagttcaagaccagcctggccaacatagtgaaaccctgtctctactaaaaatacaaaaattagccgggtgtggtggcgggcgcctgtaatcccagcttttcaagaggctgaggcagaagaatcgcttgaacccgggagatggaggttgcagtgagctgagatcgtgccactgcactccagcctgggcgttgcagtgagactccgtctcaacaacaacaaaaaggtggatacatgtcaaaagggcacaggagccacttgaaggattatacttgctaaatctgtgtcaattatcaaaataaactggtagcaacgttacaactcactgaataagataccatgattccatgttgacttaaaaatggagagaagagaaagctctaacttgaatgtcagctaatttaaggtgaaaggattttatgtgttagaaaaatcaccattttgcaaactagttttcagaatccttaatatatgtcatctcttttattcctcataacagtaataagaaacagttaactgtttcagaaaagagtggggctgcccaaggcaaggcatgttggtaattggtaagctttatagagccaagacctcaacctgattttcttgctttcatgcagttaagccatggtgctcctcttgttatatcacccttttaaacccagagattgatagtattagccatcatttgctgagtgtcatgcactattctaagtgctttacatgtatttgcctaatcagcgccctgtgaagtacatcctgtctccattttgcatataaggataccaaagcacagagttggagggaagatagttatattcccttactttatttatttatttttttgagacagggtctcgcactgtcgcccaggcttgagtgctataagaccttaagtttcccctttcaaagtagtttatagtgtctaaatatcttacataaaagtatatatcaaatagggtggcagtctggaaagatttaaaatccagaatgactggaaggttgggcaactaagatttcttaaattgcagctgttttcaacatagatgtgttgtagagtcttttcggtttcaaaattaaattgactataaatggagtgtgcttaa

SEQ ID NO: 715 - DNA, 5910 bp, Homo sapiens
ttcggagcgagcgcccgagatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacgttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatgtaggtattttgtaaaataaccttgaaattgtaaattgacacgtgtttggtcagattgtgtcaagtttaatttgttttgttttcttttttcttttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaataaaaatgtttagctttggtaataacttccaagctgaactccctctagcaagatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtcctggtatatcgtcattccatctgcagctggagctggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctaggttactactctttactttgttcacccattggggggtgcagtttttttaaaatgttgggagatggccattctaactactgttgaatgtctctgttttgggaaggtataacaagaaataaaaaagaatatatatgaagggagagactggttatctcctcccatatggttgtgcttatcctcttatggcttacaaatgaatatttggaggtttgctttcacaatgatttcccatcaacaaatatttttagtaggatttttcctgtttctgttagtccttgcagtactcataaatgttttaagctgagcatactgtaatagtcataagtttaatttcattataataaaaataatcaaacaaaaggactttagaacccaagacaatgagctagttttccctaaagtttgctgaactattaaggaatatgttcttatagcttttgactagaatgagtcatgggaattctaagaagggatggcctagacatttttagctcagttaaattcagcatttaatgcaggtgagttcctgggtcgttttccaactagtctggaacagtctggttctgactcaaactggtataaagcattattttaggttttctctttgccagtttttaagcagttataaccatgtaaatcaagatgtgaggacatctatatgaagtatagtaaagaagtggtgtcagcagatcaatatgtgtgtcctgggtgtgctgctctcttaagtgagactttgtgagactatactttaaatgcattattaccattgcttacattttgggggattttcttcctcctcaaaacttccatttctattgtaatattcttaatgacaatctttttttttttttagcagtgtatgtttgaaacagccaaagatggcgatgaaccaagtgtaaattgatctaagcagcccatgcagtttgtgttgaatcaacaaacagtgtattgttgaagtgaaattattttctgaaatgacttgttagaccagttttgaggacatactcaaaagtagagtaataatggctcctgggatggagaaatatgagatgaacctggaacattctattatggtgccacaaaggaaatctaaaaaaaaaaaaaaaaaaaaaagtggttggctaggagcagtggcacacgcctgtgattccagcactttgggaggccgaagtgggcaggagttcaagaccagcctggccaacatagtgaaaccctgtctctactaaaaatacaaaaattagccgggtgtggtggcgggcgcctgtaatcccagcttttcaagaggctgaggcagaagaatcgcttgaacccgggagatggaggttgcagtgagctgagatcgtgccactgcactccagcctgggcgttgcagtgagactccgtctcaacaacaacaaaaaggtggatacatgtcaaaagggcacaggagccacttgaaggattatacttgctaaatctgtgtcaattatcaaaataaactggtagcaacgttacaactcactgaataagataccatgattccatgttgacttaaaaatggagagaagagaaagctctaacttgaatgtcagctaatttaaggtgaaaggattttatgtgttagaaaaatcaccattttgcaaactagttttcagaatccttaatatatgtcatctcttttattcctcataacagtaataagaaacagttaactgtttcagaaaagagtggggctgcccaaggcaaggcatgttggtaattggtaagctttatagagccaagacctcaacctgattttcttgctttcatgcagttaagccatggtgctcctcttgttatatcacccttttaaacccagagattgatagtattagccatcatttgctgagtgtcatgcactattctaagtgctttacatgtatttgcctaatcagcgccctgtgaagtacatcctgtctccattttgcatataaggataccaaagcacagagttggagggaagatagttatattcccttactttatttatttatttttttgagacagggtctcgcactgtcgcccaggcttgagtgctataagaccttaagtttcccctttcaaagtagtttatagtgtctaaatatcttacataaaagtatatatcaaatagggtggcagtctggaaagatttaaaatccagaatgactggaaggttgggcaactaagatttcttaaattgcagctgttttcaacatagatgtgttgtagagtcttttcggtttcaaaattaaattgactataaatggagtgtgcttaa

SEQ ID NO: 716 - DNA, 4377 bp, Homo sapiens
ttcggagcgagcgcccgagatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggcaagcaaactgacaaaaccaagagtaacatgaaaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatgtaggtattttgtaaaataaccttgaaattgtaaattgacacgtgtttggtcagattgtgtcaagtttaatttgttttgttttcttttttcttttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaataaaaatgtttagctttggtaataacttccaagctgaactccctctagcaagatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtcctggtatatcgtcattccatctgcagctggagctggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctagcagtgtatgtttgaaacagccaaagatggcgatgaaccaagtgtaaattgatctaagcagcccatgcagtttgtgttgaatcaacaaacagtgtattgttgaagtgaaattattttctgaaatgacttgttagaccagttttgaggacatactcaaaagtagagtaataatggctcctgggatggagaaatatgagatgaacctggaacattctattatggtgccacaaaggaaatctaaaaaaaaaaaaaaaaaaaaaagtggttggctaggagcagtggcacacgcctgtgattccagcactttgggaggccgaagtgggcaggagttcaagaccagcctggccaacatagtgaaaccctgtctctactaaaaatacaaaaattagccgggtgtggtggcgggcgcctgtaatcccagcttttcaagaggctgaggcagaagaatcgcttgaacccgggagatggaggttgcagtgagct

SEQ ID NO: 717 - DNA, 4780 bp, Homo sapiens
ccccatccccaccgcctccaggctgccggggctgggccgctgtacgggagccaaggtgcggtgccccgcgtgtggacgagccgaggtgcagcccgcggggccgcagggccggggtggggcggggcgcggcgggagcagatccggtgtttgcggaatcaggaggggcgggccggggcgggccctcggcgctgcaggagctgcccagaaacttttccctgctctcaccgggcgggggagagaagccctctggacagcttctagagtgtgcaggttctcgtatccctcggccaagggtatcctctgcaaacctctgcaaacccagcgcaactacggtcccccggtcagacccaggatggggccagaacggacaggggccgcgccgctgccgctgctgctggtgttagcgctcagtcaaggcattttaaattgttgtttggcctacaatgttggtctcccagaagcaaaaatattttccggtccttcaagtgaacagtttggctatgcagtgcagcagtttataaatccaaaaggcaactggttactggttggttcaccctggagtggctttcctgagaaccgaatgggagatgtgtataaatgtcctgttgacctatccactgccacatgtgaaaaactaaatttgcaaacttcaacaagcattccaaatgttactgagatgaaaaccaacatgagcctcggcttgatcctcaccaggaacatgggaactggaggttttctcacatgtggtcctctgtgggcacagcaatgtgggaatcagtattacacaacgggtgtgtgttctgacatcagtcctgattttcagctctcagccagcttctcacctgcaactcagccctgcccttccctcatagatgttgtggttgtgtgtgatgaatcaaatagtatttatccttgggatgcagtaaagaattttttggaaaaatttgtacaaggcctggatataggccccacaaagacacaggtggggttaattcagtatgccaataatccaagagttgtgtttaacttgaacacatataaaaccaaagaagaaatgattgtagcaacatcccagacatcccaatatggtggggacctcacaaacacattcggagcaattcaatatgcaagaaaatatgcttattcagcagcttctggtgggcgacgaagtgctacgaaagtaatggtagttgtaactgacggtgaatcacatgatggttcaatgttgaaagctgtgattgatcaatgcaaccatgacaatatactgaggtttggcatagcagttcttgggtacttaaacagaaacgcccttgatactaaaaatttaataaaagaaataaaagcaatcgctagtattccaacagaaagatactttttcaatgtgtctgatgaagcagctctactagaaaaggctgggacattaggagaacaaattttcagcattgaaggtactgttcaaggaggagacaactttcagatggaaatgtcacaagtgggattcagtgcagattactcttctcaaaatgatattctgatgctgggtgcagtgggagcttttggctggagtgggaccattgtccagaagacatctcatggccatttgatctttcctaaacaagcctttgaccaaattctgcaggacagaaatcacagttcatatttaggttactctgtggctgcaatttctactggagaaagcactcactttgttgctggtgctcctcgggcaaattataccggccagatagtgctatatagtgtgaatgagaatggcaatatcacggttattcaggctcaccgaggtgaccagattggctcctattttggtagtgtgctgtgttcagttgatgtggataaagacaccattacagacgtgctcttggtaggtgcaccaatgtacatgagtgacctaaagaaagaggaaggaagagtctacctgtttactatcaaagagggcattttgggtcagcaccaatttcttgaaggccccgagggcattgaaaacactcgatttggttcagcaattgcagctctttcagacatcaacatggatggctttaatgatgtgattgttggttcaccactagaaaatcagaattctggagctgtatacatttacaatggtcatcagggcactatccgcacaaagtattcccagaaaatcttgggatccgatggagcctttaggagccatctccagtactttgggaggtccttggatggctatggagatttaaatggggattccatcaccgatgtgtctattggtgcctttggacaagtggttcaactctggtcacaaagtattgctgatgtagctatagaagcttcattcacaccagaaaaaatcactttggtcaacaagaatgctcagataattctcaaactctgcttcagtgcaaagttcagacctactaagcaaaacaatcaagtggccattgtatataacatcacacttgatgcagatggattttcatccagagtaacctccagggggttatttaaagaaaacaatgaaaggtgcctgcagaagaatatggtagtaaatcaagcacagagttgccccgagcacatcatttatatacaggagccctctgatgttgtcaactctttggatttgcgtgtggacatcagtctggaaaaccctggcactagccctgcccttgaagcctattctgagactgccaaggtcttcagtattcctttccacaaagactgtggtgaggacggactttgcatttctgatctagtcctagatgtccgacaaataccagctgctcaagaacaaccctttattgtcagcaaccaaaacaaaaggttaacattttcagtaacgctgaaaaataaaagggaaagtgcatacaacactggaattgttgttgatttttcagaaaacttgttttttgcatcattctccctgccggttgatgggacagaagtaacatgccaggtggctgcatctcagaagtctgttgcctgcgatgtaggctaccctgctttaaagagagaacaacaggtgacttttactattaactttgacttcaatcttcaaaaccttcagaatcaggcgtctctcagtttccaagccttaagtgaaagccaagaagaaaacaaggctgataatttggtcaacctcaaaattcctctcctgtatgatgctgaaattcacttaacaagatctaccaacataaatttttatgaaatctcttcggatgggaatgttccttcaatcgtgcacagttttgaagatgttggtccaaaattcatcttctccctgaaggttggaagtgttccagtaagcatggcaactgtaatcatccacatccctcagtataccaaagaaaagaacccactgatgtacctaactggggtgcaaacagacaaggctggtgacatcagttgtaatgcagatatcaatccactgaaaataggacaaacatcttcttctgtatctttcaaaagtgaaaatttcaggcacaccaaagaattgaactgcagaactgcttcctgtagtaatgttacctgctggttgaaagacgttcacatgaaaggagaatactttgttaatgtgactaccagaatttggaacgggactttcgcatcatcaacgttccagacagtacagctaacggcagctgcagaaatcaacacctataaccctgagatatatgtgattgaagataacactgttacgattcccctgatgataatgaaacctgatgagaaagccgaagtaccaacaggagttataataggaagtataattgctggaatccttttgctgttagctctggttgcaattttatggaagctcggcttcttcaaaagaaaatatgaaaagatgaccaaaaatccagatgagattgatgagaccacagagctcagtagctgaaccagcagacctacctgcagtgggaaccggcagcatcccagccagggtttgctgtttgcgtgaatggatttctttttaaatcccatattttttttatcatgtcgtaggtaaactaacctggtattttaagagaaaactgcaggtcagtttggaatgaagaaattgtggggggtgggggaggtgcggggggcaggtagggaaataatagggaaaatacctattttatatgatgggggaaaaaaagtaatctttaaactggctggcccagagtttacattctaatttgcattgtgtcagaaacatgaaatgcttccaagcatgacaacttttaaagaaaaatatgatactctcagattttaagggggaaaactgttctctttaaaatatttgtctttaaacagcaactacagaagtggaagtgcttgatatgtaagtacttccacttgtgtatattttaatgaatattgatgttaacaagaggggaaaacaaaacacaggttttttcaatttatgctgctcatccaaagttgccacagatgatacttccaagtgataattttatttataaactaggtaaaatttgttgttggttccttttagaccacggctgccccttccacaccccatcttgctctaatgatcaaaacatgcttgaataactgagcttagagtatacctcctatatgtccatttaagttaggagagggggcgatatagagactaaggcacaaaattttgtttaaaactcagaatataacatgtaaaatcccatctgctagaagcccatcctgtgccagaggaagatttgtttggctgactggcagtaacctagtgaatttctgaaagatgagtaatttctttggcaaccttcctcctcccttactgaac

SEQ ID NO: 718 - DNA, 4461 bp, Homo sapiens
ttcggagcgagcgcccgagatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagtgtttagaatctccagtggggaagaggaaaagaagcatgactgttagtacttctcaggacccatctttctcaggattaaaccagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggcaagcaaactgacaaaaccaagagtaacatgaaaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatgtaggtattttgtaaaataaccttgaaattgtaaattgacacgtgtttggtcagattgtgtcaagtttaatttgttttgttttcttttttcttttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaataaaaatgtttagctttggtaataacttccaagctgaactccctctagcaagatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtcctggtatatcgtcattccatctgcagctggagctggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctagcagtgtatgtttgaaacagccaaagatggcgatgaaccaagtgtaaattgatctaagcagcccatgcagtttgtgttgaatcaacaaacagtgtattgttgaagtgaaattattttctgaaatgacttgttagaccagttttgaggacatactcaaaagtagagtaataatggctcctgggatggagaaatatgagatgaacctggaacattctattatggtgccacaaaggaaatctaaaaaaaaaaaaaaaaaaaaaagtggttggctaggagcagtggcacacgcctgtgattccagcactttgggaggccgaagtgggcaggagttcaagaccagcctggccaacatagtgaaaccctgtctctactaaaaatacaaaaattagccgggtgtggtggcgggcgcctgtaatcccagcttttcaagaggctgaggcagaagaatcgcttgaacccgggagatggaggttgcagtgagct

SEQ ID NO: 719 - DNA, 4341 bp, Homo sapiens
ttcggagcgagcgcccgagatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatgtaggtattttgtaaaataaccttgaaattgtaaattgacacgtgtttggtcagattgtgtcaagtttaatttgttttgttttcttttttcttttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaataaaaatgtttagctttggtaataacttccaagctgaactccctctagcaagatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtcctggtatatcgtcattccatctgcagctggagctggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctagcagtgtatgtttgaaacagccaaagatggcgatgaaccaagtgtaaattgatctaagcagcccatgcagtttgtgttgaatcaacaaacagtgtattgttgaagtgaaattattttctgaaatgacttgttagaccagttttgaggacatactcaaaagtagagtaataatggctcctgggatggagaaatatgagatgaacctggaacattctattatggtgccacaaaggaaatctaaaaaaaaaaaaaaaaaaaaaagtggttggctaggagcagtggcacacgcctgtgattccagcactttgggaggccgaagtgggcaggagttcaagaccagcctggccaacatagtgaaaccctgtctctactaaaaatacaaaaattagccgggtgtggtggcgggcgcctgtaatcccagcttttcaagaggctgaggcagaagaatcgcttgaacccgggagatggaggttgcagtgagct

SEQ ID NO: 720 - DNA, 5108 bp, Homo sapiens
ggcgagtgcgtcgagctcgccgcggactcaagatggcggcgtgtggacgtgtacggaggatgttccgcttgtcggcggcgctgcatctgctgctgctattcgcggccggggccgagaaactccccggccagggcgtccacagccagggccagggtcccggggccaactttgtgtccttcgtagggcaggccggaggcggcggcccggcgggtcagcagctgccccagctgcctcagtcatcgcagcttcagcagcaacagcagcagcagcaacagcaacagcagcctcagccgccgcagccgcctttcccggcgggtgggcctccggcccggcggggaggagcgggggctggtgggggctggaagctggcggaggaagagtcctgcagggaggacgtgacccgcgtgtgccctaagcacacctggagcaacaacctggcggtgctcgagtgcctgcaggatgtgagggagcctgaaaatgaaatttcttcagactgcaatcatttgttgtggaattataagctgaacctaactacagatcccaaatttgaatctgtggccagagaggtttgcaaatctactataacagagattaaagaatgtgctgatgaaccggttggaaaaggttacatggtttcctgcttggtggatcaccgaggcaacatcactgagtatcagtgtcaccagtacattaccaagatgacggccatcatttttagtgattaccgtttaatctgtggcttcatggatgactgcaaaaatgacatcaacattctgaaatgtggcagtattcggcttggagaaaaggatgcacattcacaaggtgaggtggtatcatgcttggagaaaggcctggtgaaagaagcagaagaaagagaacccaagattcaagtttctgaactctgcaagaaagccattctccgggtggctgagctgtcatcggatgactttcacttagaccggcatttatattttgcttgccgagatgatcgggagcgtttttgtgaaaatacacaagctggtgagggcagagtgtataagtgcctctttaaccataaatttgaagaatccatgagtgaaaagtgtcgagaagcacttacaacccgccaaaagctgattgcccaggattataaagtcagttattcattggccaaatcctgtaaaagtgacttgaagaaataccggtgcaatgtggaaaaccttccgcgatcgcgtgaagccaggctctcctacttgttaatgtgcctggagtcagctgtacacagagggcgacaagtcagcagtgagtgccagggggagatgctggattaccgacgcatgttgatggaagacttttctctgagccctgagatcatcctaagctgtcggggggagattgaacaccattgttccggattacatcgaaaagggcggaccctacactgtctgatgaaagtagttcgaggggagaaggggaaccttggaatgaactgccagcaggcgcttcaaacactgattcaggagactgaccctggtgcagattaccgcattgatcgagctttgaatgaagcttgtgaatctgtaatccagacagcctgcaaacatataagatctggagacccaatgatcttgtcgtgcctgatggaacatttatacacagagaagatggtagaagactgtgaacaccgtctcttagagctgcagtatttcatctcccgggattggaagctggaccctgtcctgtaccgcaagtgccagggagacgcttctcgtctttgccacacccacggttggaatgagaccagtgaatttatgcctcagggagctgtgttctcttgtttatacagacacgcctaccgcactgaggaacagggaaggaggctctcacgggagtgccgagctgaagtccaaaggatcctacaccagcgtgccatggatgtcaagctggatcctgccctccaggataagtgcctgattgatctgggaaaatggtgcagtgagaaaacagagactggacaggagctggagtgccttcaggaccatctggatgacttggtggtggagtgtagagatatagttggcaacctcactgagttagaatcagaggatattcaaatagaagccttgctgatgagagcctgtgagcccataattcagaacttctgccacgatgtggcagataaccagatagactctggggacctgatggagtgtctgatacagaacaaacaccagaaggacatgaacgagaagtgtgccatcggagttacccacttccagctggtgcagatgaaggattttcggttttcttacaagtttaaaatggcctgcaaggaggacgtgttgaagctttgcccaaacataaaaaagaaggtggacgtggtgatctgcctgagcacgaccgtgcgcaatgacactctgcaggaagccaaggagcacagggtgtccctgaagtgccgcaggcagctccgtgtggaggagctggagatgacggaggacatccgcttggagccagatctatacgaagcctgcaagagtgacatcaaaaacttctgttccgctgtgcaatatggcaacgctcagattatcgaatgtctgaaagaaaacaagaagcagctaagcacccgctgccaccaaaaagtatttaagctgcaggagacagagatgatggacccagagctagactacaccctcatgagggtctgcaagcagatgataaagaggttctgtccggaagcagattctaaaaccatgttgcagtgcttgaagcaaaataaaaacagtgaattgatggatcccaaatgcaaacagatgataaccaagcgccagatcacccagaacacagattaccgcttaaaccccatgttaagaaaagcctgtaaagctgacattcctaaattctgtcacggtatcctgactaaggccaaggatgattcagaattagaaggacaagtcatctcttgcctgaagctgagatatgctgaccagcgcctgtcttcagactgtgaagaccagatccgaatcattatccaggagtccgccctggactaccgcctggatcctcagctccagctgcactgctcagacgagatctccagtctatgtgctgaagaagcagcagcccaagagcagacaggtcaggtggaggagtgcctcaaggtcaacctgctcaagatcaaaacagaattgtgtaaaaaggaagtgctaaacatgctgaaggaaagcaaagcagacatctttgttgacccggtacttcatactgcttgtgccctggacattaaacaccactgcgcagccatcacccctggccgcgggcgtcaaatgtcctgtctcatggaagcactggaggataagcgggtgaggttacagcccgagtgcaaaaagcgcctcaatgaccggattgagatgtggagttacgcagcaaaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacaggtagagccaccttgaccaccaaaggaactacctatccagtgcccagtttgtacagccctcttgtatagcatccccactcacctcgctcttctcagaagtgacaccaaccccgtgttagagcattagcagatgtccactgcgttgtcccatccagcctccactcgtgtccatggtgtcctcctcctcctcaccgtgcagcagcagcagctggtcgctggggttactgcctttgtttggcaaacttgggtttacctgcctgtagacaagtctctctcataccaacagaacttccggtacttccagaaccaactcacctgacctgcaactcaaaggcttttttaagaaaaccaccaaaaaaaaaaatttttttaaagaaaaaaatgtatatagtaacgcatctcctccaggcttgatttgggcaatggggttatgtctttcatatgactgtgtaaaacaaagacaggacttggaggggaagcacaccacccagtgtgccatgactgaggtgtctcgttcatctctcagaagcaccttggggcctcgccagggccgtggtcttcaccgaggcgtgggtgggcagccgttccccaggctgtccatgggtatttctgtggtctcctcgcttcattgaagcaaagcatgagccttcctagacaagggcagctggggaggggaagggaccggaagtttgtgaagttgaacagtccatccatctgcactgagaggctggatcctgagtcccggggcagcaggatcccaggaaccttcctcctccagggcagcacaggactcagccatgtctggaccggccctgctgaggctacagtcactctggaagctctgcgcttcatcaggaggcaggactgtggcgggaggggtccttgaagatgggtgtggggagcagtgggtcaggaagtgggagccagaggtttgactcactttgctttatttttcaggctacaatacaggtcagagacaatggcttataaaggtttagtgtggtctcaggatgtgacaggcagtccagcctgacctttctgcacactccagacaaacttcccagacaagctcctttgtgcctctacgtggagagggtgtggaaagttatcacattaaaagatggaggatttgctctgttttttttctttctgtccatttgctgcgtgtacccactctagtaggcattggctaaatgttgtattttggcgattcatcaacctttgcagaatatgggctttatagaagcaatattcttggccatcccgcctcattcctccagtgtggagatgacaagtctgggtgtgagagggaggggtccgggcatcatggttcagcgtggcactcctttggttgagtttggggcatgagatcacagtggctgcacaagagagcagtgtgtacagtaggagagacatttatgtaatatatattttattaacctgttagatgtccacaaagtattataaatcacgtgcctaaaactgtccatgtagaccaaggcctgccctcggcgccccccactcttgcctctgctctgcac

SEQ ID NO: 721 - DNA, 3901 bp, Homo sapiens
aagatggcggcgtgtggacgtgtacggaggatgttccgcttgtcggcggcgctgcatctgctgctgctattcgcggccggggccgagaaactccccggccatggcgtccacagccagggccagggtcccggggccaactttgtgtccttcgtagggcaggccggaggcggcggcccggcgggtcagcagctgccccagctgcttcagtcatcgcagcttcagcagcaacagcagcagcagcaacagcaacagcagcttcagccgccgcagccgcctttcccggcgggtgggcctccggcccggcggggaggagcgggggctggtgggggctggaagctggcggaggaagagtcctgcagggaggacgtgacccgcgtgtgccctaagcacacctggagcaacaacctggcggtgctcgagtgcctgcaggatgtgagggagcctgaaaatgaaatttcttcagactgcaatcatttgttgtggaattataagctgaacctaactacagatcccaaatttgaatctgtggccagagaggtttgcaaatctactataacagagattaaagaatgtgctgatgaaccggttggaaaaggttacatggtttcctgcttagtggatcaccgaggcaacatcactgagtatcagtgtcaccagtacattaccaagatgacggccatcatttttagtgattaccgtttaatctgtggcttcatggatgactgcaaaaatgacatcaacattctgaaatgtggcagtattcggcttggagaaaaggatgcacattcacaaggtgaggtggtatcatgcttggagaaaggcctggtgaaagaagcagaagaaagagaacccaagattcaagtttctgaactctgcaagaaagccattctccgggtggctgagctgtcatcggatgactttcacttagaccggcatttatattttgcttgccgagatgatcgggagcgtttttgtgaaaatacacaagctggtgagggcagagtgtataagtgcctctttaaccataaatttgaagaatccatgagtgaaaagtgtcgagaagcacttacaacccgccaaaagctgattgcccaggattataaagtcagttattcattggccaaatcctgtaaaagtgacttgaagaaataccggtgcaatgtggaaaaccttccgcgatcgcgtgaagccaggctctcctacttgttaatgtgcctggagtcagctgtacacagagggcgacaagtcagcagtgagtgccagggggagatgctggattaccgacgcatgttgatggaagacttttctctgagccctgagatcatcctaagctgtcggggggagattgaacaccattgttccggattacatcgaaaagggcggaccctacactgtctgatgaaagtagttcgaggggagaaggggaaccttggaatgaactgccagcaggcgcttcaaacactgattcaggagactgaccctggtgcagattaccgcattgatcgagctttgaatgaagcttgtgaatctgtaatccagacagcctgcaaacatataagatctggagacccaatgatcttgtcgtgcctgatggaacatttatacacagagaagatggtagaagactgtgaacaccgtctcttagagctgcagtatttcatctcccgggattggaagctggaccctgtcctgtaccgcaagtgccagggagacgcttctcgtctttgccacacccacggttggaatgagaccagtgaatttatgcctcagggagctgtgttctcttgtttatacagacacgcctaccgcactgaggaacagggaaggaggctctcacgggagtgccgagctgaagtccaaaggatcctacaccagcgtgccatggatgtcaagctggatcctgccctccaggataagtgcctgattgatctgggaaaatggtgcagtgagaaaacagagactggacaggagctggagtgccttcaggaccatctggatgacttggtggtggagtgtagagatatagttggcaacctcactgagttagaatcagaggatattcaaatagaagccttgctgatgagagcctgtgagcccataattcagaacttctgccacgatgtggcagataaccagatagactctggggacctgatggagtgtctgatacagaacaaacaccagaaggacatgaacgagaagtgtgccatcggagttacccacttccagctggtgcagatgaaggattttcggttttcttacaagtttaaaatggcctgcaaggaggacgtgttgaagctttgcccaaacataaaaaagaaggtggacgtggtgatctgcctgagcacgaccgtgcgcaatgacactctgcaggaagccaaggagcacagggtgtccctgaagtgccgcaggcagctccgtgtggaggagctggagatgacggaggacatccgcttggagccagatctatacgaagcctgcaagagtgacatcaaaaacttctgttccgctgtgcaatatggcaacgctcagattatcgaatgtctgaaagaaaacaagaagcagctaagcacccgctgccaccaaaaagtatttaagctgcaggagacagagatgatggacccagagctagactacaccctcatgagggtctgcaagcagatgataaagaggttctgtccggaagcagattctaaaaccatgttgcagtgcttgaagcaaaataaaaacagtgaattgatggatcccaaatgcaaacagatgataaccaagcgccagatcacccagaacacagattaccgcttaaaccccatgttaagaaaagcctgtaaagctgacattcctaaattctgtcacggtatcctgactaaggccaaggatgattcagaattagaaggacaagtcatctcttgcctgaagctgagatatgctgaccagcgcctgtcttcagactgtgaagaccagatccgaatcattatccaggagtccgccctggactaccgcctggatcctcagctccagctgcactgctcagacgagatctccagtctatgtgctgaagaagcagcagcccaagagcagacaggtcaggtggaggagtgcctcaaggtcaacctgctcaagatcaaaacagaattgtgtaaaaaggaagtgctaaacatgctgaaggaaagcaaagcagacatctttgttgacccggtacttcatactgcttgtgccctggacattaaacaccactgcgcagccatcacccctggccgcgggcgtcaaatgtcctgtctcatggaagcactggaggataagcgggtgaggttacagcccgagtgcaaaaagcgcctcaatgaccggattgagatgtggagttacgcagcaaaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacaggtagagccaccttgaccaccaaaggaactacctatccagtgcccagtttgtacagccctcttgtatagcatccccactcacctcgctcttctcagaagtgacaccaaccccgtgttagagcattagcagatgtccactgcgttgtcccatccagcctccactcgtgtccatggtgtcctcctcctcctcaccgtgcagcagcagcagctggtcgctggggttactgcctttgtttggcaaacttgggtttacctgcctgtagacaagtctctctcataccaacagaacttccggtacttccagaaccaactcacctgacctgcaactcaaaggcttttttaagaaaaccaccaaaaaaaaaa

SEQ ID NO: 722 - DNA, 3909 bp, Homo sapiens
ggcacgaggctcgccgcggactcaagatggcggcgtgtggacgtgtacggaggatgttccgcttgtcggcggcgctgcatctgctgctgctattcgcggccgggggcagaaactccccggccagggcgtcccacagccagggccagggtcccggggccaactttgtgtccttcgtagggcaggccggaggcggcggcccggcgggtcagcagctgccccagctgcctcagtcatcgcagcttcagcagcaacagcagcagcagcaacagcaacagcagcctcagccgccgcagccgcctttcccggcgggtgggcctccgcggcggggaggagcgggggctggtgggggctggaagctggcggaggaagagtcctgcagggaggacgtgacccgcgtgtgccctaagcacacctggagcaacaacctggcggtgctcgagtgcctgcaggatgtgagggagcctgaaaatgaaatttcttcagactgcaatcatttgttgtggaattataagctgaacctaactacagatcccaaatttgaatctgtggccagagaggtttgcaaatctactataacagagattaaagaatgtgctgatgaaccggttggaaaaggttacatggtttcctgcttagtggatcaccgaggcaacatcactgagtatcagtgtcaccagtacattaccaagatgacggccatcatttttagtgattaccgtttaatctgtggcttcatggatgactgcaaaaatgacatcaacattctgaaatgtggcagtattcggcttggagaaaaggatgcacattcacaaggtgaggtggtatcatgcttggagaaaggcctggtgaaagaagcagaagaaagagaacccaagattcaagtttctgaactctgcaagaaagccattctccgggtggctgagctgtcatcggatgactttcacttagaccggcatttatattttgcttgccgagatgatcgggagcgtttttgtgaaaatacacaagctggtgagggcagagtgtataagtgcctctttaaccataaatttgaagaatccatgagtgaaaagtgtcgagaagcacttacaacccgccaaaagctgattgcccaggattataaagtcagttattcattggccaaatcctgtaaaagtgacttgaagaaataccggtgcaatgtggaaaaccttccgcgatcgcgtgaagccaggctctcctacttgttaatgtgcctggagtcagctgtacacagagggcgacaagtcagcagtgagtgccagggggagatgctggattaccgacgcatgttgatggaagacttttctctgagccctgagatcatcctaagctgtcggggggagattgaacaccattgttccggattacatcgaaaaggacggaccctacactgtctgatgaaggtagttcgaggggagaaggggaaccttggaatgaactgccagcaggcgcttcaaacactgattcaggagactgaccctggtgcagattaccgcattgatcgagctttgaatgaagcttgtgaatctgtaatccagacagcctgcaaacatataagatctggagacccaatgatctcgtcgtgcctgatggaacatttatacacagagaagatggtagaagactgtgaacaccgtctcttagagctgcagtatttcatctcccgggattggaagctggaccctgtcctgtaccgcaagtgccagggagacgcttctcgtctttgccacacccacggttggaatgagaccagtgaatttatgcctcagggagctgtgttctcttgtttatacagacacgcctaccgcactgaagaacagggaaggaggctctcacgggagtgccgagctgaagtccaaaggatcctacaccagcgtgccatggatgtcaagctggatcctgccctccaggataagtgcctgattgatctgggaaaatggtgcagtgagaaaacagagactggacaggagctggagtgccttcaggaccatctggatgacttggtggtggagtgtagagatatagttggcaacctcactgagttagaatcagaggatatccaaatagaagccttgctgatgagagcctgtgagcccataattcagacattctgccacgatgcggataaccagatagactctggggacctgatggagtgtctgatacagaacaaacaccagaaggacatgaacgagaagtgtgccatcggagttacccacttccagctggtgcagatgaaggattttcggttttcttacaagtttaaaatggcctgcaaggaggacgtgttgaagctttgcccaaacataaaaaagaaggtggacgtggtgatctgcctgagcacgaccgtgcgcaatgacactctgcaggaagccaaggagcacagggtgtccctgaagtgccgcaggcagctccgtgtggaggagctggagatgacggaggacatccgcttggagccagatctatacgaagcctgcaagagtgacatcaaaaacttctgttccgctgtgcaatatggcaacgctcagattatcgaatgtctgaaagaaaacaagaagcagctaagcacccgctgccaccaaaaagtatttaagctgcaggagacagagatgatggacccagagctagactacaccctcatgagggtctgcaagcagatgataaagaggttctgtccggaagcagattctaaaaccatgttgcagtgcttgaagcaaaataaaaacagtgaattgatggatcccaaatgcaaacagatgataaccaagcgccagatcacccagaacacagattaccgcttaaaccccatgttaagaaaagcctgtaaagctgacattcctaaattctgtcacggtatcctgactaaggccaaggatgattcagaattagaaggacaagtcatctcttgcctgaagctgagatatgctgaccagcgcctgtcttcagactgtgaagaccagatccgaatcattatccaggagtccgccctggactaccgcctggatcctcagctccagctgcactgctcagacgagatctccagtctatgtgctgaagaagcagcagcccaagagcagacaggtcaggtggaggagtgcctcaaggtcaacctgctcaagatcaaaacagaattgtgtaaaaaggaagtgctaaacatgctgaaggaaagcaaagcagacatctttgttgacccggtacttcatactgcttgtgccctggacattaaacaccactgcgcagcactcacccctggccgcgggcgtcaaatgtcctgtctcatggaagcactggaggataagcgggtgaggttacagcccgagtgcaaaaagcgcctcaatgaccggattgagatgtggagttacgcagcaaaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacaggtagagccaccttgaccaccaaaggaactacctatccagtgcccagtttgtacagccctcttgtatagcatccccactcacctcgctcttctcagaagtgacaccaaccccgtgttagagcattagcagatgtccactgcgttgtcccatccagcctccactcgtgtccatggtgtcctcctcctcctcaccgtgcagcagcagcagctggtcgctggggttactgcctttgtttggcaaacttgggtttacctgcctgtagacaagtctctctcataccaacagaacttccggtacttccagaaccaactcacctgacctgcaactcaaaggcttttttaagaaaaccacca

SEQ ID NO: 723 - DNA, 5191 bp, Homo sapiens
ggcgagtgcgtcgagctcgccgcggactcaagatggcggcgtgtggacgtgtacggaggatgttccgcttgtcggcggcgctgcatctgctgctgctattcgcggccggggccgagaaactccccggccagggcgtccacagccagggccagggtcccggggccaactttgtgtccttcgtagggcaggccggaggcggcggcccggcgggtcagcagctgccccagctgcctcagtcatcgcagcttcagcagcaacagcagcagcagcaacagcaacagcagcctcagccgccgcagccgcctttcccggcgggtgggcctccggcccggcggggaggagcgggggctggtgggggctggaagctggcggaggaagagtcctgcagggaggacgtgacccgcgtgtgccctaagcacacctggagcaacaacctggcggtgctcgagtgcctgcaggatgtgagggagcctgaaaatgaaatttcttcagactgcaatcatttgttgtggaattataagctgaacctaactacagatcccaaatttgaatctgtggccagagaggtttgcaaatctactataacagagattaaagaatgtgctgatgaaccggttggaaaaggttacatggtttcctgcttggtggatcaccgaggcaacatcactgagtatcagtgtcaccagtacattaccaagatgacggccatcatttttagtgattaccgtttaatctgtggcttcatggatgactgcaaaaatgacatcaacattctgaaatgtggcagtattcggcttggagaaaaggatgcacattcacaaggtgaggtggtatcatgcttggagaaaggcctggtgaaagaagcagaagaaagagaacccaagattcaagtttctgaactctgcaagaaagccattctccgggtggctgagctgtcatcggatgactttcacttagaccggcatttatattttgcttgccgagatgatcgggagcgtttttgtgaaaatacacaagctggtgagggcagagtgtataagtgcctctttaaccataaatttgaagaatccatgagtgaaaagtgtcgagaagcacttacaacccgccaaaagctgattgcccaggattataaagtcagttattcattggccaaatcctgtaaaagtgacttgaagaaataccggtgcaatgtggaaaaccttccgcgatcgcgtgaagccaggctctcctacttgttaatgtgcctggagtcagctgtacacagagggcgacaagtcagcagtgagtgccagggggagatgctggattaccgacgcatgttgatggaagacttttctctgagccctgagatcatcctaagctgtcggggggagattgaacaccattgttccggattacatcgaaaagggcggaccctacactgtctgatgaaagtagttcgaggggagaaggggaaccttggaatgaactgccagcaggcgcttcaaacactgattcaggagactgaccctggtgcagattaccgcattgatcgagctttgaatgaagcttgtgaatctgtaatccagacagcctgcaaacatataagatctggagacccaatgatcttgtcgtgcctgatggaacatttatacacagagaagatggtagaagactgtgaacaccgtctcttagagctgcagtatttcatctcccgggattggaagctggaccctgtcctgtaccgcaagtgccagggagacgcttctcgtctttgccacacccacggttggaatgagaccagtgaatttatgcctcagggagctgtgttctcttgtttatacagacacgcctaccgcactgaggaacagggaaggaggctctcacgggagtgccgagctgaagtccaaaggatcctacaccagcgtgccatggatgtcaagctggatcctgccctccaggataagtgcctgattgatctgggaaaatggtgcagtgagaaaacagagactggacaggagctggagtgccttcaggaccatctggatgacttggtggtggagtgtagagatatagttggcaacctcactgagttagaatcagaggatattcaaatagaagccttgctgatgagagcctgtgagcccataattcagaacttctgccacgatgtggcagataaccagatagactctggggacctgatggagtgtctgatacagaacaaacaccagaaggacatgaacgagaagtgtgccatcggagttacccacttccagctggtgcagatgaaggattttcggttttcttacaagtttaaaatggcctgcaaggaggacgtgttgaagctttgcccaaacataaaaaagaaggtggacgtggtgatctgcctgagcacgaccgtgcgcaatgacactctgcaggaagccaaggagcacagggtgtccctgaagtgccgcaggcagctccgtgtggaggagctggagatgacggaggacatccgcttggagccagatctatacgaagcctgcaagagtgacatcaaaaacttctgttccgctgtgcaatatggcaacgctcagattatcgaatgtctgaaagaaaacaagaagcagctaagcacccgctgccaccaaaaagtatttaagctgcaggagacagagatgatggacccagagctagactacaccctcatgagggtctgcaagcagatgataaagaggttctgtccggaagcagattctaaaaccatgttgcagtgcttgaagcaaaataaaaacagtgaattgatggatcccaaatgcaaacagatgataaccaagcgccagatcacccagaacacagattaccgcttaaaccccatgttaagaaaagcctgtaaagctgacattcctaaattctgtcacggtatcctgactaaggccaaggatgattcagaattagaaggacaagtcatctcttgcctgaagctgagatatgctgaccagcgcctgtcttcagactgtgaagaccagatccgaatcattatccaggagtccgccctggactaccgcctggatcctcagctccagctgcactgctcagacgagatctccagtctatgtgctgaagaagcagcagcccaagagcagacaggtcaggtggaggagtgcctcaaggtcaacctgctcaagatcaaaacagaattgtgtaaaaaggaagtgctaaacatgctgaaggaaagcaaagcagacatctttgttgacccggtacttcatactgcttgtgccctggacattaaacaccactgcgcagccatcacccctggccgcgggcgtcaaatgtcctgtctcatggaagcactggaggataagcgggtgaggttacagcccgagtgcaaaaagcgcctcaatgaccggattgagatgtggagttacgcagcaaaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacaggtagagccaccttgaccaccaaaggaactacctatccagtgcccagtttgtacagccctcttgtatagcatccccactcacctcgctcttctcagaagtgacaccaaccccgtgttagagcattagcagatgtccactgcgttgtcccatccagcctccactcgtgtccatggtgtcctcctcctcctcaccgtgcagcagcagcagctggtcgctggggttactgcctttgtttggcaaacttgggtttacctgcctgtagacaagtctctctcataccaacagaacttccggtacttccagaaccaactcacctgacctgcaactcaaaggcttttttaagaaaaccaccaaaaaaaaaaatttttttaaagaaaaaaatgtatatagtaacgcatctcctccaggcttgatttgggcaatggggttatgtctttcatatgactgtgtaaaacaaagacaggacttggaggggaagcacaccacccagtgtgccatgactgaggtgtctcgttcatctctcagaagcaccttggggcctcgccagggccgtggtcttcaccgaggcgtgggtgggcagccgttccccaggctgtgtggggtcctgctttcttctgctgagacagtgacgctttccagtttccaccctaatcagccactgctggtcacagccccacagccatgggtatttctgtggtctcctcgcttcattgaagcaaagcatgagccttcctagacaagggcagctggggaggggaagggaccggaagtttgtgaagttgaacagtccatccatctgcactgagaggctggatcctgagtcccggggcagcaggatcccaggaaccttcctcctccagggcagcacaggactcagccatgtctggaccggccctgctgaggctacagtcactctggaagctctgcgcttcatcaggaggcaggactgtggcgggaggggtccttgaagatgggtgtggggagcagtgggtcaggaagtgggagccagaggtttgactcactttgctttatttttcaggctacaatacaggtcagagacaatggcttataaaggtttagtgtggtctcaggatgtgacaggcagtccagcctgacctttctgcacactccagacaaacttcccagacaagctcctttgtgcctctacgtggagagggtgtggaaagttatcacattaaaagatggaggatttgctctgttttttttctttctgtccatttgctgcgtgtacccactctagtaggcattggctaaatgttgtattttggcgattcatcaacctttgcagaatatgggctttatagaagcaatattcttggccatcccgcctcattcctccagtgtggagatgacaagtctgggtgtgagagggaggggtccgggcatcatggttcagcgtggcactcctttggttgagtttggggcatgagatcacagtggctgcacaagagagcagtgtgtacagtaggagagacatttatgtaatatatattttattaacctgttagatgtccacaaagtattataaatcacgtgcctaaaactgtccatgtagaccaaggcctgccctcggcgccccccactcttgcctctgctctgcac

SEQ ID NO: 724 - DNA, 1677 bp, Homo sapiens
gtggcacatccacacatgagggaaaaacactgccaggacatctcagggcactctcaggaaatgaggaagctgctggagaagtttctagccttggggcaggcagagtggctcctcacagcctgaagctcatccttctgcacgggccagccaggccagcacagaggcaccagggcagcagtgcacacaggtccccggggaccccaccatgtggagcggatggtggctgtggccccttgtggccgtctgcactgcagacttctttcgggacgaggcagagaggatcatgagggactcccctgtcattgatgggcacaatgacctcccctggcagctgctggatatgttcaacaaccggctgcaggacgagagggccaacctgaccaccttggccggcacacacaccaacatccccaagctgagggccggctttgtgggaggccagttctggtccgtgtacacgccctgcgacacccagaacaaagacgccgtgcggaggacgctggagcagatggacgtggtccaccgcatgtgccggatgtacccggagaccttcctgtatgtcaccagcagtgcaggcattcggcaggccttccgggaagggaaggtggccagcctgatcggcgtggagggcggccactccattgacagcagtttgggcgtcctgcgggcactctatcagctgggcatgcggtacctgaccctcacccacagctgcaacacgccctgggctgacaactggctggtggacacgggagacagcgagccccagagccaaggcttgtcaccctttgggcagcgtgtggtgaaggagctgaaccgtctgggggtcctcatcgacttggctcacgtgtctgtggccaccatgaaggccaccctgcagctgtccagagccccggtcatcttcagccactcctcggcctacagcgtgtgcgcaagccggcgcaacgtgcctgacgacgtcctgaggctggtgaaacagacagacagcctggtgatggtgaacttctacaacaattacatttcctgcaccaacaaggccaacctgtcccaagtggccgaccatctggatcacatcaaggaggtggcaggagccagagccgtgggttttggtggggactttgatggtgttccaagggtccctgaggggctggaggacgtctccaagtatccagacctgatcgctgagctgctcaggaggaactggacggaggcggaggtcaagggcgcactggctgacaacctgctgagggtcttcgaggctgtggaacaggccagcaacctcacacaggctcccgaggaggagcccatcccgctggaccagctgggtggctcctgcaggacccattacggctactcctctggggcttccagcctccatcgccactgggggctcctgctggcctccctcgctcccctggtcctctgtctgtctctcctgtgaaacctgggagaccagagtcccctttagggttcccggagctccgggaagacccgcccatcccaggactccagatgccaggagccctgctgcccacatgcaaggaccagcatctcctgagaggacgcctgggcttacctggggggcaggatgcctggggacagttcaggacacacacacagtaggcccgcaataaaagcaacaccccttcacatcctggggtacgtgtcatcggcatc

SEQ ID NO: 725 - DNA, 3570 bp, Homo sapiens
acagtgctgggattccaggcgtgagccaccgcgcccggccgggggtcacagttgttagaatctgttacgggacccaccttcatcccttgcccaccaccagcgacacaggggcaggaagtatcttcaacccaaatggctgtgttccccctaaaagcggggggttttaaactcacaaaggaaaaggaggagaatggatcctcactcagccaccagctctgacagccccagctcccccttcctctgcgttccccttccttctcctttccccttccttctcatttttcctcacgagagctcctaccctcaccaccaccagctcctgggaaaaccttggagaacttcagtcctttggaagtttagaaggatctgattggagtttgggtgcagggctcttccctggggacagaggcagcagagaggcctgggtagcccccaaagcctgtactcgacaccctgctccccaggaggatggtggtcccaggccccccaaggtcaggacgttccaattacccaggcacccaccatattccccaagaggcaatttgatctttaaactgaaaactctcagaaacagtatcacccccaggcccttgcccctcacgtctccaatcctgtccactgaggtcaattggctccttgtgtcccaccctcagacaatgtgtctgccccccagcctcctcaacagaaaaagcccctggaagggatgggctacccagctccctgagctcctggctcggggttccctcccctgggggtgggcacagttgggaaatgcagcctgcacaggtgtgttcaggtggccggtgatatgtcacccccgcggcctagacttcagtcctgcgtctgtcgtgaggagtaggaagtggggagagcagcccagaggccaggagctcggaagcccccaggtcccagtggccgccctgactgcctggcctctccccggcaaactccaggcacaatgacctcccctggcagctgctggatatgttcaacaaccggctgcaggacgagagggccaacctgaccaccttggccggcacacacaccaacatccccaagctgagggccggctttgtgggaggccaggtaccgcctgccctgccttgtgcttgccctgtgtggggtcatcccgtctcctacctcaggcctggctacagtgggaccatccctgtggtgttcctccagggtccctcggtgcccaggccgagggagggcttcccagcgggtgggaaaccagactcccacaggcatgcggggggtgggctgagacctggctgcatcagctcctggcaccccctgcggcccacagttctggtccgtgtacacgccctgcgacacccagaacaaagacgccgtgcggaggacgctggagcagatggacgtggtccaccgcatgtgccggatgtacccggagaccttcctgtatgtcaccagcagtgcaggtggggtcctgacctgggtcctccaggtcctgcgtcttctcacccagccctcatcctgagcagcaggtgccggtcaggacacctcaccctccagataccaggtgcccactcccctgcaccctgactctccccgcaggcattcggcaggccttccgggaagggaaggtggccagcctgatcggcgtggagggcggccactccattgacagcagtttgggcgtcctgcgggcactctatcagctgggcatgcggtacctgaccctcacccacagctgcaacacgccctggtgcgtgactccccatgggaggcccccgggctgtggtcaggagggagggggcagacactccctgccaccctccagagcccatcccctctggctgtgagtcccaggccgggcctcgcctgctgggctgatgggaggccgagaccaccgctcacctcttgggcacctgccttttggttctccagggctgacaactggctggtggacacgggagacagcgagccccagagccaaggcttgtcaccctttgggcaggtgagtggggtgggagcggccagtcacccccgaggagaaggcagaggccctggagggtgaccagaacaatgcatctcctcacgtgggacctcagtgtccttgtctgtaaaatggagctggcagccatccccccagggtgggtgctgagccctgagtggccccggacttccagccacgaaggatgatgactcacatctggtccagcccgtccacctccgcagccccgaccctgggggctgtgagggtggacggagccctgtcttcccagcgtgtggtgaaggagctgaaccgtctgggggtcctcatcgacttggctcacgtgtctgtggccaccatgaaggccaccctgcagctgtccagagccccggtcatcttcagccactcctcggcctacagcgtgtgcgcaagccggcgcaacgtgcctgacgacgtcctgaggctggtggtgagggccgagggggcgacctccaccccgcctccctgggcaggccctcccagctctcagcttcaccctgtcttccttcttgtgcagaaacagacagacagcctggtgatggtgaacttctacaacaattacatttcctgcaccaacaaggccaacctgtcccaagtggccggtaggtggggtgtgagcggccaagggggccgaagggggagggcctcactcgggacccatacctgctgctccctggacagaccatctggatcacatcaaggaggtggcaggagccagagccgtgggttttggtggggactttgatggtgttccaaggtaaggggctgagagctctgtcctgtggatgagccgggaggttcatggcctcgtcagagggatgaggtggctggaggagggacctgtgtcctagtgtgggggcccaggttctcctggcctcaacacagggtccctgaggggctggaggacgtctccaagtatccagacctgatcgctgagctgctcaggaggaactggacggaggcggaggtcaagggcgcactggctgacaacctgctgagggtcttcgaggctgtggaacaggtgaggatggggtgaccgcctgagtctccccccccaccaccagcagacagactgccccacccgtgtctgtctgtccccaggccagcaacctcacacaggctcccgaggaggagcccatcccgctggaccagctgggtggctcctgcaggacccattacggctactcctctggggcttccagcctccatcgccactgggggctcctgctggcctccctcgctcccctggtcctctgtctgtctctcctgtgaaacctgggagaccagagtcccctttagggttcccggagctccgggaagacccgcccatcccaggactccagatgccaggagccctgctgcccacatgcaaggaccagcatctcctgagaggacgcctgggcttacctggggggcaggatgcctggggacagttcaggacacacacacagtaggcccgcaataaaagcaacaccccttcacatcctggggtacgtgtcatcggcatccggctcaggaggtggggtgttttgtgaaaattgctcctggttggacgtggggcactcctgtgatcc

SEQ ID NO: 726 - DNA, 1767 bp, Homo sapiens
ccctggggtactgtgcgagccctcaaggaggtggctgttctgtagctggagagctccgtgggtggcaggactgaacttgaacaccagaaacaacccccaagccttgtgacctgggaggcaggaggcgggtctgtctccctgggacttgggtggctgagccgaggtactcgggaccctgtcccgcgcatggcagagtggctcctcacagcctgaagctcatccttctgcacgggccagccaggccagcacagaggcaccagggcagcagtgcacacaggtccccggggaccccaccatgtggagcggatggtggctgtggccccttgtggccgtctgcactgcagacttctttcgggacgaggcagagaggatcatgagggactcccctgtcattgatgggcacaatgacctcccctggcagctgctggatatgttcaacaaccggctgcaggacgagagggccaacctgaccaccttggccggcacacacaccaacatccccaagctgagggccggctttgtgggaggccagttctggtccgtgtacacgccctgcgacacccagaacaaagacgccgtgcggaggacgctggagcagatggacgtggtccaccgcatgtgccggatgtacccggagaccttcctgtatgtcaccagcagtgcaggcattcggcaggccttccgggaagggaaggtggccagcctgatcggcgtggagggcggccactccattgacagcagtttgggcgtcctgcgggcactctatcagctgggcatgcggtacctgaccctcacccacagctgcaacacgccctgggctgacaactggctggtggacacgggagacagcgagccccagagccaaggcttgtcaccctttgggcagcgtgtggtgaaggagctgaaccgtctgggggtcctcatcgacttggctcacgtgtctgtggccaccatgaaggccaccctgcagctgtccagagccccggtcatcttcagccactcctcggcctacagcgtgtgcgcaagccggcgcaacgtgcctgacgacgtcctgaggctggtgaaacagacagacagcctggtgatggtgaacttctacaacaattacatttcctgcaccaacaaggccaacctgtcccaagtggccgaccatctggatcacatcaaggaggtggcaggagccagagccgtgggttttggtggggactttgatggtgttccaagggtccctgaggggctggaggacgtctccaagtatccagacctgatcgctgagctgctcaggaggaactggacggaggcggaggtcaagggcgcactggctgacaacctgctgagggtcttcgaggctgtggaacaggccagcaacctcacacaggctcccgaggaggagcccatcccgctggaccagctgggtggctcctgcaggacccattacggctactcctctggggcttccagcctccatcgccactgggggctcctgctggcctccctcgctcccctggtcctctgtctgtctctcctgtgaaacctgggagaccagagtcccctttagggttcccggagctccgggaagacccgcccatcccaggactccagatgccaggagccctgctgcccacatgcaaggaccagcatctcctgagaggacgcctgggcttacctggggggcaggatgcctggggacagttcaggacacacacacagtaggcccgcaataaaagcaacaccccttcacatcctggggtacgtgtcatcggcatc

SEQ ID NO: 727 - DNA, 2416 bp, Homo sapiens
cgcgcagtcgcgcgcgggtcgtgccgtaccaccgtcgcgggcaggctcggccacgagcgccagagccccgcgcctcccctcgcggcctgtcccaagtccctgccccgcaacagagcgtcacttccgccatccccggcagcggttggggcggggcgcacgggggagggggccaggtcggagggaagcccgcccgtgcccgagcccgcgcccgagcagggactacatttcccgaggggcctcggcggcggctgcggcgacgggcgcggcaacgtcccccggaagtggagcccgggacttccactcgtgcgtgaggcgagaggagccggagacgagaccagaggccgaactcgggttctgacaagatggccgggctgccccgcaggatcatcaaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaagataagtggtccccagcactgcagatccgcacagttctgctatcgatccaggccttgttaagtgctcccaatccagatgatccattagcaaatgatgtagcggagcagtggaagaccaacgaagcccaagccatagaaacagctagagcatggactaggctatatgccatgaataatatttaaattgatacgatcatcaagtgtgcatcacttctcctgttctgccaagacttcctcctctttgtttgcatttaatggacacagtcttagaaacattacagaataaaaaagcccagacatcttcagtcctttggtgattaaatgcacattagcaaatctatgtcttgtcctgattcactgtcataaagcatgagcagaggctagaagtatcatctggattgttgtgaaacgtttaaaagcagtggcccctccctgcttttattcatttcccccatcctggtttaagtataaagcactgtgaatgaaggtagttgtcaggttagctgcaggggtgtgggtgtttttattttattttattttattttatttttgaggggggaggtagtttaattttatgggctcctttcccccttttttggtgatctaattgcattggttaaaagcagctaaccaggtctttagaatatgctctagccaagtctaactttatttagacgctgtagatggacaagcttgattgttggaaccaaaatgggaacattaaacaaacatcacagccctcactaataacattgctgtcaagtgtagattccccccttcaaaaaaagcttgtgaccattttgtatggcttgtctggaaacttctgtaaatcttatgttttagtaaaatattttttgttattctactttgcctttgtacagtttattttactgtgtttatttcattttcccaatttgacaatcgtattttaaaattgaaactgatggaacattctttcttggtcttcaccatctgacaaattgaatggcaagaggtggattttgccagtttcttttcactgatgcagatttgtgttaagatagtactgaatggagtatttataaactggccctgagcatgcataaagcatcagtatctgacctttttttaaccttctaggaatttgaaataaatgtgtttgtgttgtctgattagatgatcattggtgtcttgccacaatgtttaaaaattactgtacaggaaagtcacagcaaagatagcagttgtgactgacatgtaggactttcacagttgtgccacattaacctttcatgtgtgttaagaaacactgatctgatcatttgggatttgctgaggcatttgtgagtcttccttataaacctgatgagcagatctcaactatctagcttgtgtgtcatcagaaaggtttatccctttgagagtatcaagtcctcagttaatgattcttgctttcatccctccactcgttttattctttaatttggaattcagtaatttttcttctttattgacgaattcctcccctcacaaaactgttctttcccacctctctccatatctaattcctgattcttgttatttttaagtcataaatgtagccagtcataaatacataaatgttaaccttcgggttgcaaccttgtctcttgcagtttaaggtaatggatattgtagcccatttgaattttcttcactcttattctcgtaattctggagtttcttcagattgtggtgtattttattgtgctcctatgtaagatgaagaattaactattaaaattacattttcaacatac

SEQ ID NO: 728 - DNA, 2446 bp, Homo sapiens
cgcgcagtcgcgcgcgggtcgtgccgtaccaccgtcgcgggcaggctcggccacgagcgccagagccccgcgcctcccctcgcggcctgtcccaagtccctgccccgcaacagagcgtcacttccgccatccccggcagcggttggggcggggcgcacgggggagggggccaggtcggagggaagcccgcccgtgcccgagcccgcgcccgagcagggactacatttcccgaggggcctcggcggcggctgcggcgacgggcgcggcaacgtcccccggaagtggagcccgggacttccactcgtgcgtgaggcgagaggagccggagacgagaccagaggccgaactcgggttctgacaagatggccgggctgccccgcaggatcatcaaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaagataagtggtccccagcactgcagatccgcacagttctgctatcgatccaggccttgttaagtgctcccaatccagatgatccattagcaaatgatgtagcggagcagtggaagaccaacgaagcccaagccatagaaacagctagagcatggactaggctatatgccatgaataatatttaaattgatacgatcatcaagtgtgcatcacttctcctgttctgccaagacttcctcctctttgtttgcatttaatggacacagtcttagaaacattacagaataaaaaagcccagacatcttcagtcctttggtgattaaatgcacattagcaaatctatgtcttgtcctgattcactgtcataaagcatgagcagaggctagaagtatcatctggattgttgtgaaacgtttaaaagcagtggcccctccctgcttttattcatttcccccatcctggtttaagtataaagcactgtgaatgaaggtagttgtcaggttagctgcaggggtgtgggtgtttttattttattttattttattttatgggctcctttcccccttttttggtgatctaattgcattggttaaaagcagctaaccaggtctttagaatatgctctagccaagtctaactttatttagacgctgtagatggacaagcttgattgttggaaccaaaatgggaacattaaacaaacatcacagccctcactaataacattgctgtcaagtgtagattccccccttcaaaaaaagcttgtgaccattttgtatggcttgtctggaaacttctgtaaatcttatgttttagtaaaatattttttgttattctactttgcctttgtacagtttattttactgtgtttatttcattttcccaatttgacaatcgtattttaaaattgaaactgatggaacattctttcttggtcttcaccatctgacaaattgaatggcaagaggtggattttgccagtttcttttcactgatgcagatttgtgttaagatagtactgaatggagtatttataaactggccctgagcatgcataaagcatcagtatctgacctttttttaaccttctaggaatttgaaataaatgtgtttgtgttgtctgattagatgatcattggtgtcttgccacaatgtttaaaaattactgtacaggaaagtcacagcaaagatagcagttgtgactgacatgtaggactttcacagttgtgccacatttttgcctaaaatttgggttatgacatttttcttggttcttatctgaaaatttcatctgtaacctttcatgtgtgttaagaaacactgatctgatcatttgggatttgctgaggcatttgtgagtcttccttataaacctgatgagcagatctcaactatctagcttgtgtgtcatcagaaaggtttatccctttgagagtatcaagtcctcagttaatgattcttgctttcatccctccactcgttttattctttaatttggaattcagtaatttttcttctttattgacgaattcctcccctcacaaaactgttctttcccacctctctccatatctaattcctgattcttgttatttttaagtcataaatgtagccagtcataaatacataaatgttaaccttcgggttgcaaccttgtctcttgcagtttaaggtaatggatattgtagcccatttgaattttcttcactcttattctcgtaattctggagtttcttcagattgtggtgtattttattgtgctcctatgtaagatgaagaattaactattaaaattacattttcaacatac

SEQ ID NO: 729 - DNA, 2489 bp, Homo sapiens
cgcgcagtcgcgcgcgggtcgtgccgtaccaccgtcgcgggcaggctcggccacgagcgccagagccccgcgcctcccctcgcggcctgtcccaagtccctgccccgcaacagagcgtcacttccgccatccccggcagcggttggggcggggcgcacgggggagggggccaggtcggagggaagcccgcccgtgcccgagcccgcgcccgagcagggactacatttcccgaggggcctcggcggcggctgcggcgacgggcgcggcaacgtcccccggaagtggagcccgggacttccactcgtgcgtgaggcgagaggagccggagacgagaccagaggccgaactcgggttctgacaagatggccgggctgccccgcaggatcatcaaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaagataagtggtccccagcactgcagatccgcacagttctgctatcgatccaggccttgttaagtgctcccaatccagatgatccattagcaaatgatgtagcggagcagtggaagaccaacgaagcccaagccatagaaacagctagagcatggactaggctatatgccatgaataatatttaaattgatacgatcatcaagtgtgcatcacttctcctgttctgccaagacttcctcctctttgtttgcatttaatggacacagtcttagaaacattacagaataaaaaagcccagacatcttcagtcctttggtgattaaatgcacattagcaaatctatgtcttgtcctgattcactgtcataaagcatgagcagaggctagaagtatcatctggattgttgtgaaacgtttaaaagcagtggcccctccctgcttttattcatttcccccatcctggtttaagtataaagcactgtgaatgaaggtagttgtcaggttagctgcaggggtgtgggtgtttttattttattttattttattttatttttgaggggggaggtagtttaattttatgggctcctttcccccttttttggtgatctaattgcattggttaaaagcagctaaccaggtctttagaatatgctctagccaagtctaactttatttagacgctgtagatggacaagcttgattgttggaaccaaaatgggaacattaaacaaacatcacagccctcactaataacattgctgtcaagtgtagattccccccttcaaaaaaagcttgtgaccattttgtatggcttgtctggaaacttctgtaaatcttatgttttagtaaaatattttttgttattctactttgcctttgtacagtttattttactgtgtttatttcattttcccaatttgacaatcgtattttaaaattgaaactgatggaacattctttcttggtcttcaccatctgacaaattgaatggcaagaggtggattttgccagtttcttttcactgatgcagatttgtgttaagatagtactgaatggagtatttataaactggccctgagcatgcataaagcatcagtatctgacctttttttaaccttctaggaatttgaaataaatgtgtttgtgttgtctgattagatgatcattggtgtcttgccacaatgtttaaaaattactgtacaggaaagtcacagcaaagatagcagttgtgactgacatgtaggactttcacagttgtgccacatttttgcctaaaatttgggttatgacatttttcttggttcttatctgaaaatttcatctgtaacctttcatgtgtgttaagaaacactgatctgatcatttgggatttgctgaggcatttgtgagtcttccttataaacctgatgagcagatctcaactatctagcttgtgtgtcatcagaaaggtttatccctttgagagtatcaagtcctcagttaatgattcttgctttcatccctccagtatttgctgtgggagctcgttttattctttaatttggaattcagtaatttttcttctttattgacgaattcctcccctcacaaaactgttctttcccacctctctccatatctaattcctgattcttgttatttttaagtcataaatgtagccagtcataaatacataaatgttaaccttcgggttgcaaccttgtctcttgcagtttaaggtaatggatattgtagcccatttgaattttcttcactcttattctcgtaattctggagtttcttcagattgtggtgtattttattgtgctcctatgtaagatgaagaattaactattaaaattacattttcaacat

SEQ ID NO: 730 - DNA, 2568 bp, Homo sapiens
cgcgcgcgcagtcgcgcgcgggtcgtgccgtaccaccgtcgcgggcaggctcggccacgagcgccagagccccgcgcctcccctcgcggcctgtcccaagtccctgccccgcaacagagcgtcacttccgccatccccggcagcggttggggcggggcgcacgggggagggggccaggtcggagggaagcccgcccgtgcccgagcccgcgcccgagcagggactacatttcccgaggggcctcggcggcggctgcggcgacgggcgcggcaacgtcccccggaagtggagcccgggacttccactcgtgcgtgaggcgagaggagccggagacgagaccagaggccgaactcgggttctgacaagatggccgggctgccccgcaggatcatcaaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaagataagtggtccccagcactgcagatccgcacagttctgctatcgatccaggccttgttaagtgctcccaatccagatgatccattagcaaatgatgtagcggagcagtggaagaccaacgaagcccaagccatagaaacagctagagcatggactaggctatatgccatgaataatatttaaattgatacgatcatcaagtgtgcatcacttctcctgttctgccaagacttcctcctctttgtttgcatttaatggacacagtcttagaaacattacagaataaaaaagcccagacatcttcagtcctttggtgattaaatgcacattagcaaatctatgtcttgtcctgattcactgtcataaagcatgagcagaggctagaagtatcatctggattgttgtgaaacgtttaaaagcagtggcccctccctgcttttattcatttcccccatcctggtttaagtataaagcactgtgaatgaaggtagttgtcaggttagctgcaggggtgtgggtgtttttattttattttattttattttatttttgaggggggaggtagtttaattttatgggctcctttcccccttttttggtgatctaattgcattggttaaaagcagctaaccaggtctttagaatatgctctagccaagtctaactttatttagacgctgtagatggacaagcttgattgttggaaccaaaatgggaacattaaacaaacatcacagccctcactaataacattgctgtcaagtgtagattccccccttcaaaaaaagcttgtgaccattttgtatggcttgtctggaaacttctgtaaatcttatgttttagtaaaatattttttgttattctactttgcctttgtacagtttattttactgtgtttatttcattttcccaatttgacaatcgtattttaaaattgaaactgatggaacattctttcttggtcttcaccatctgacaaattgaatggcaagaggtggattttgccagtttcttttcactgatgcagatttgtgttaagatagtactgaatggagtatttataaactggccctgagcatgcataaagcatcagtatctgacctttttttaaccttctaggaatttgaaataaatgtgtttgtgttgtctgattagatgatcattggtgtcttgccacaatgtttaaaaattactgtacaggaaagtcacagcaaagatagcagttgtgactgacatgtaggactttcacagttgtgccacatttttgcctaaaatttgggttatgacatttttcttggttcttatctgaaaatttcatctgtaacctttcatgtgtgttaagaaacactgatctgatcatttgggatttgctgaggcatttgtgagtcttccttataaacctgatgagcagatctcaactatctagcttgtgtgtcatcagaaaggtttatccctttgagagtatcaagtcctcagttaatgattcttgctttcatccctccagtatttgctgtgggagctcgttttattctttaatttggaattcagtaatttttcttctttattgacgaattcctcccctcacaaaactgttctttcccacctctctccatatctaattcctgattcttgttatttttaagtcataaatgtagccagtcataaatacataaatgttaaccttcgggttgcaaccttgtctcttgcagtttaaggtaatggatattgtagcccatttgaattttcttcactcttattctcgtaattctggagtttcttcagattgtggtgtattttattgtgctcctatgtaagatgaagaattaactattaaaattacattttcaacatacaaaagcttttgatgactggtaactggtatccttccaaataaatgcattgcttggtaaaaaaaaaaaaaaaaaa

SEQ ID NO: 731 - DNA, 1539 bp, Homo sapiens
gaccggacgcggcgacggtgcggggcggcgctggccctgaggtaggcggcggtaagaggggccgcccgcggcccccggctcactccggcactccgggccgctcggcctccatgcctgcccgaccgcgctgccggagccccaggtgaccagcgccatgtccagccaggtggtgggcattgagcctctctacatcaaggcagagccggccagccctgacagtccaaagggttcctcggagacagagaccgagcctcctgtggccctggcccctggtccagctcccactcgctgcctcccaggccacaaggaagaggaggatggggagggggctgggcctggcgagcagggcggtgggaagctggtgctcagctccctgcccaagcgcctctgcctggtctgtggggacgtggcctccggctaccactatggtgtggcatcctgtgaggcctgcaaagccttcttcaagaggaccatccaggggagcatcgagtacagctgtccggcctccaacgagtgtgagatcaccaagcggagacgcaaggcctgccaggcctgccgcttcaccaagtgcctgcgggtgggcatgctcaaggaggtgcaaacgaggcgtgggtcccggaagctctgttctgcgggtggccgctcgcgcctgcgcagtggaggcggcccaggcccgccttccgcagggtgtcgccgctgtgccgctagcggtgccccgcctgctgcggtggcaccagccaggaggcggagtggaagtggccgtggggcgggtatgggactagctggcgtgtgcgccctgagacgctcagcgggctatatactcgtcggtggggccggcggtcagtctgcggcagcggcagcaagacggtgcagtgaaggagagtgggcgtctggcggggtccgcagtttcagcagagccgctgcagccatggccccaatcaaggtgggagatgccatcccagcagtggaggtgtttgaaggggagccagggaacaaggtgaacctggcagagctgttcaagggcaagaagggtgtgctgtttggagttcctggggccttcacccctggatgttccaagacacacctgccagggtttgtggagcaggctgaggctctgaaggccaagggagtccaggtggtggcctgtctgagtgttaatgatgcctttgtgactggcgagtggggccgagcccacaaggcggaaggcaaggttcggctcctggctgatcccactggggcctttgggaaggagacagacttattactagatgattcgctggtgtccatctttgggaatcgacgtctcaagaggttctccatggtggtacaggatggcatagtgaaggccctgaatgtggaaccagatggcacaggcctcacctgcagcctggcacccaatatcatctcacagctctgaggccctgggccagattacttcctccacccctccctatctcacctgcccagccctgtgctggggccctgcaattggaatgttggccagatttctgcaataaacacttgtggtttgcggccatc

SEQ ID NO: 732 - DNA, 890 bp, Homo sapiens
ctgcgcagtggaggcggcccaggcccgccttccgcagggtgtcgccgctgtgccgctagcggtgccccgcctgctgcggtggcaccagccaggaggcggagtggaagtggccgtggggcgggtatgggactagctggcgtgtgcgccctgagacgctcagcgggctatatactcgtcggtggggccggcggtcagtctgcggcagcggcagcaagacggtgcagtgaaggagagtgggcgtctggcggggtccgcagtttcagcagagccgctgcagccatggccccaatcaaggtgggagatgccatcccagcagtggaggtgtttgaaggggagccagggaacaaggtgaacctggcagagctgttcaagggcaagaagggtgtgctgtttggagttcctggggccttcacccctggatgttccaagacacacctgccagggtttgtggagcaggctgaggctctgaaggccaagggagtccaggtggtggcctgtctgagtgttaatgatgcctttgtgactggcgagtggggccgagcccacaaggcggaaggcaaggttcggctcctggctgatcccactggggcctttgggaaggagacagacttattactagatgattcgctggtgtccatctttgggaatcgacgtctcaagaggttctccatggtggtacaggatggcatagtgaaggccctgaatgtggaaccagatggcacaggcctcacctgcagcctggcacccaatatcatctcacagctctgaggccctgggccagattacttcctccacccctccctatctcacctgcccagccctgtgctggggccctgcaattggaatgttggccagatttctgcaataaacacttgtggtttgcggccatc

SEQ ID NO: 733 - DNA, 959 bp, Homo sapiens
gcagtggaggcggcccaggcccgccttccgcagggtgtcgccgctgtgccgctagcggtgccccgcctgctgcggtggcaccagccaggaggcggagtggaagtggccgtggggcgggtatgggactagctggcgtgtgcgccctgagacgctcagcgggctatatactcgtcggtggggccggcggtcagtctgcggcagcggcagcaagacggtgcagtgaaggagagtgggcgtctggcggggtccgcagtttcagcagagccgctgcagccatggccccaatcaaggtgggagatgccatcccagcagtggaggtgtttgaaggggagccagggaacaaggtgaacctggcagagctgttcaagggcaagaagggtgtgctgtttggagttcctggggccttcacccctggatgttccaagacacacctgccagggtttgtggagcaggctgaggctctgaaggccaagggagtccaggtggtggcctgtctgagtgttaatgatgcctttgtgactggcgagtggggccgagcccacaaggcggaaggcaaggttcggctcctggctgatcccactggggcctttgggaaggagacagacttattactagatgattcgctggtgtccatctttgggaatcgacgtctcaagaggttctccatggtggtacaggatggcatagtgaaggccctgaatgtggaaccagatggcacaggcctcacctgcagcctggcacccaatatcatctcacagctctgaggccctgggccagattacttcctccacccctccctatctcacctgcccagccctgtgctggggccctgcaattggaatgttggccagatttctgcaataaacacttgtggtttgcggccaaaaaaaaaaaaaaaaaaaaaaaaaaaaaaaaaaaaaaaaaaaaaaaaaaaaaaaaaaaaaaaaaaaaaaaaaaaa

SEQ ID NO: 734 - DNA, 827 bp, Homo sapiens
gcagtggaggcggcccaggcccgccttccgcagggtgtcgccgctgtgccgctagcggtgccccgcctgctgcggtggcaccagccaggaggcggagtggaagtggccgtggggcgggtatgggactagctggcgtgtgcgccctgagacgctcagcgggctatatactcgtcggtggggccggcggtcagtctgcggcagcggcagcaagacggtgcagtgaaggagagtgggcgtctggcggggtccgcagtttcagcagagccgctgcagccatggccccaatcaaggtgggagatgccatcccagcagtggaggtgtttgaaggggagccagggaacaaggtgaacctggcagagctgttcaagggcaagaagggtgtgctgtttggagttcctggggccttcacccctggatgttccaaggttcggctcctggctgatcccactggggcctttgggaaggagacagacttattactagatgattcgctggtgtccatctttgggaatcgacgtctcaagaggttctccatggtggtacaggatggcatagtgaaggccctgaatgtggaaccagatggcacaggcctcacctgcagcctggcacccaatatcatctcacagctctgaggccctgggccagattacttcctccacccctccctatctcacctgcccagccctgtgctggggccctgcaattggaatgttggccagatttctgcaataaacacttgtggtttgcggccaaaaaaaaaaaaaaaaaaaaaaaaaaaaaaaaaaaaaaaaaaaaaaaaaaaaaaaaaaaaaaaaaaaaaaaaaaaa

SEQ ID NO: 735 - DNA, 943 bp, Homo sapiens
tgcaaacgaggcgtgggtcccggaagctctgttctgcgggtggccgctcgcgcctgcgcagtggaggcggcccaggcccgccttccgcagggtgtcgccgctgtgccgctagcggtgccccgcctgctgcggtggcaccagccaggaggcggagtggaagtggccgtggggcgggtatgggactagctggcgtgtgcgccctgagacgctcagcgggctatatactcgtcggtggggccggcggtcagtctgcggcagcggcagcaagacggtgcagtgaaggagagtgggcgtctggcggggtccgcagtttcagcagagccgctgcagccatggccccaatcaaggtgggagatgccatcccagcagtggaggtgtttgaaggggagccagggaacaaggtgaacctggcagagctgttcaagggcaagaagggtgtgctgtttggagttcctggggccttcacccctggatgttccaagacacacctgccagggtttgtggagcaggctgaggctctgaaggccaagggagtccaggtggtggcctgtctgagtgttaatgatgcctttgtgactggcgagtggggccgagcccacaaggcggaaggcaaggttcggctcctggctgatcccactggggcctttgggaaggagacagacttattactagatgattcgctggtgtccatctttgggaatcgacgtctcaagaggttctccatggtggtacaggatggcatagtgaaggccctgaatgtggaaccagatggcacaggcctcacctgcagcctggcacccaatatcatctcacagctctgaggccctgggccagattacttcctccacccctccctatctcacctgcccagccctgtgctggggccctgcaattggaatgttggccagatttctgcaataaacacttgtggtttgcggccatc

SEQ ID NO: 736 - DNA, 8411 bp, Homo sapiens
gcgatccgggcgccaccccgcggtcatcggtcaccggtcgctctcaggaacagcagcgcaacctctgctccctgcctcgcctcccgcgcgcctaggtgcctgcgactttaattaaagggccgtcccctcgccgaggctgcagcaccgcccccccggcttctcgcgcctcaaaatgagtagctcccactctcgggcgggccagagcgcagcaggcgcggctccgggcggcggcgtcgacacgcgggacgccgagatgccggccaccgagaaggacctggcggaggacgcgccgtggaagaagatccagcagaacactttcacgcgctggtgcaacgagcacctgaagtgcgtgagcaagcgcatcgccaacctgcagacggacctgagcgacgggctgcggcttatcgcgctgttggaggtgctcagccagaagaagatgcaccgcaagcacaaccagcggcccactttccgccaaatgcagcttgagaacgtgtcggtggcgctcgagttcctggaccgcgagagcatcaaactggtgtccatcgacagcaaggccatcgtggacgggaacctgaagctgatcctgggcctcatctggaccctgatcctgcactactccatctccatgcccatgtgggacgaggaggaggatgaggaggccaagaagcagacccccaagcagaggctcctgggctggatccagaacaagctgccgcagctgcccatcaccaacttcagccgggactggcagagcggccgggccctgggcgccctggtggacagctgtgccccgggcctgtgtcctgactgggactcttgggacgccagcaagcccgttaccaatgcgcgagaggccatgcagcaggcggatgactggctgggcatcccccaggtgatcacccccgaggagattgtggaccccaacgtggacgagcactctgtcatgacctacctgtcccagttccccaaggccaagctgaagccaggggctcccttgcggcccaaactgaacccgaagaaagcccgtgcctacgggccaggcatcgagcccacaggcaacatggtgaagaagcgggcagagttcactgtggagaccagaagtgctggccagggagaggtgctggtgtacgtggaggacccggccggacaccaggaggaggcaaaagtgaccgccaataacgacaagaaccgcaccttctccgtctggtacgtccccgaggtgacggggactcataaggttactgtgctctttgctggccagcacatcgccaagagccccttcgaggtgtacgtggataagtcacagggtgacgccagcaaagtgacagcccaaggtcccggcctggagcccagtggcaacatcgccaacaagaccacctactttgagatctttacggcaggagctggcacgggcgaggtcgaggttgtgatccaggaccccatgggacagaagggcacggtagagcctcagctggaggcccggggcgacagcacataccgctgcagctaccagcccaccatggagggcgtccacaccgtgcacgtcacgtttgccggcgtgcccatccctcgcagcccctacactgtcactgttggccaagcctgtaacccgagtgcctgccgggcggttggccggggcctccagcccaagggtgtgcgggtgaaggagacagctgacttcaaggtgtacacaaagggcgctggcagtggggagctgaaggtcaccgtgaagggccccaagggagaggagcgcgtgaagcagaaggacctgggggatggcgtgtatggcttcgagtattaccccatggtccctggaacctatatcgtcaccatcacgtggggtggtcagaacatcgggcgcagtcccttcgaagtgaaggtgggcaccgagtgtggcaatcagaaggtacgggcctggggccctgggctggagggcggcgtcgttggcaagtcagcagactttgtggtggaggctatcggggacgacgtgggcacgctgggcttctcggtggaagggccatcgcaggctaagatcgaatgtgacgacaagggcgacggctcctgtgatgtgcgctactggccgcaggaggctggcgagtatgccgttcacgtgctgtgcaacagcgaagacatccgcctcagccccttcatggctgacatccgtgacgcgccccaggacttccacccagacagggtgaaggcacgtgggcctggattggagaagacaggtgtggccgtcaacaagccagcagagttcacagtggatgccaagcacggtggcaaggccccacttcgggtccaagtccaggacaatgaaggctgccctgtggaggcgttggtcaaggacaacggcaatggcacttacagctgctcctacgtgcccaggaagccggtgaagcacacagccatggtgtcctggggaggcgtcagcatccccaacagccccttcagggtgaatgtgggagctggcagccaccccaacaaggtcaaagtatacggccccggagtagccaagacagggctcaaggcccacgagcccacctacttcactgtggactgcgccgaggctggccagggggacgtcagcatcggcatcaagtgtgcccctggagtggtaggccccgccgaagctgacatcgacttcgacatcatccgcaatgacaatgacaccttcacggtcaagtacacgccccggggggctggcagctacaccattatggtcctctttgctgaccaggccacgcccaccagccccatccgagtcaaggtggagccctctcatgacgccagtaaggtgaaggccgagggccctggcctcagtcgcactggtgtcgagcttggcaagcccacccacttcacagtaaatgccaaagctgctggcaaaggcaagctggacgtccagttctcaggactcaccaagggggatgcagtgcgagatgtggacatcatcgaccaccatgacaacacctacacagtcaagtacacgcctgtccagcagggtccagtaggcgtcaatgtcacttatggaggggatcccatccctaagagccctttctcagtggcagtatctccaagcctggacctcagcaagatcaaggtgtctggcctgggagagaaggtggacgttggcaaagaccaggagttcacagtcaaatcaaagggtgctggtggtcaaggcaaagtggcatccaagattgtgggcccctcgggtgcagcggtgccctgcaaggtggagccaggcctgggggctgacaacagtgtggtgcgcttcctgccccgtgaggaagggccctatgaggtggaggtgacctatgacggcgtgcccgtgcctggcagcccctttcctctggaagctgtggcccccaccaagcctagcaaggtgaaggcgtttgggccggggctgcagggaggcagtgcgggctcccccgcccgcttcaccatcgacaccaagggcgccggcacaggtggcctgggcctgacggtggagggcccctgtgaggcgcagctcgagtgcttggacaatggggatggcacatgttccgtgtcctacgtgcccaccgagcccggggactacaacatcaacatcctcttcgctgacacccacatccctggctccccattcaaggcccacgtggttccctgctttgacgcatccaaagtcaagtgctcaggccccgggctggagcgggccaccgctggggaggtgggccaattccaagtggactgctcgagcgcgggcagcgcggagctgaccattgagatctgctcggaggcggggcttccggccgaggtgtacatccaggaccacggtgatggcacgcacaccattacctacattcccctctgccccggggcctacaccgtcaccatcaagtacggcggccagcccgtgcccaacttccccagcaagctgcaggtggaacctgcggtggacacttccggtgtccagtgctatgggcctggtattgagggccagggtgtcttccgtgaggccaccactgagttcagtgtggacgcccgggctctgacacagaccggagggccgcacgtcaaggcccgtgtggccaacccctcaggcaacctgacggagacctacgttcaggaccgtggcgatggcatgtacaaagtggagtacacgccttacgaggagggactgcactccgtggacgtgacctatgacggcagtcccgtgcccagcagccccttccaggtgcccgtgaccgagggctgcgacccctcccgggtgcgtgtccacgggccaggcatccaaagtggcaccaccaacaagcccaacaagttcactgtggagaccaggggagctggcacgggcggcctgggcctggctgtagagggcccctccgaggccaagatgtcctgcatggataacaaggacggcagctgctcggtcgagtacatcccttatgaggctggcacctacagcctcaacgtcacctatggtggccatcaagtgccaggcagtcctttcaaggtccctgtgcatgatgtgacagatgcgtccaaggtcaagtgctctgggcccggcctgagcccaggcatggttcgtgccaacctccctcagtccttccaggtggacacaagcaaggctggtgtggccccattgcaggtcaaagtgcaagggcccaaaggcctggtggagccagtggacgtggtagacaacgctgatggcacccagaccgtcaattatgtgcccagccgagaagggccctacagcatctcagtactgtatggagatgaagaggtaccccggagccccttcaaggtcaaggtgctgcctactcatgatgccagcaaggtgaaggccagtggccccgggctcaacaccactggcgtgcctgccagcctgcccgtggagttcaccatcgatgcaaaggacgccggggagggcctgctggctgtccagatcacggatcccgaaggcaagccgaagaagacacacatccaagacaaccatgacggcacgtatacagtggcctacgtgccagacgtgacaggtcgctacaccatcctcatcaagtacggtggtgacgagatccccttctccccgtaccgcgtgcgtgccgtgcccaccggggacgccagcaagtgcactgtcacaggtgctggcatcggccccaccattcagattggggaggagacggtgatcactgtggacactaaggcggcaggcaaaggcaaagtgacgtgcaccgtgtgcacgcctgatggctcagaggtggatgtggacgtggtggagaatgaggacggcactttcgacatcttctacacggccccccagccgggcaaatacgtcatctgtgtgcgctttggtggcgagcacgtgcccaacagccccttccaagtgacggctctggctggggaccagccctcggtgcagccccctctacggtctcagcagctggccccacagtacacctacgcccagggcggccagcagacttgggccccggagaggcccctggtgggtgtcaatgggctggatgtgaccagcctgaggccctttgaccttgtcatccccttcaccatcaagaagggcgagatcacaggggaggttcggatgccctcaggcaaggtggcgcagcccaccatcactgacaacaaagacggcaccgtgaccgtgcggtatgcacccagcgaggctggcctgcacgagatggacatccgctatgacaacatgcacatcccaggaagccccttgcagttctatgtggattacgtcaactgtggccatgtcactgcctatgggcctggcctcacccatggagtagtgaacaagcctgccaccttcaccgtcaacaccaaggatgcaggagaggggggcctgtctctggccattgagggcccgtccaaagcagaaatcagctgcactgacaaccaggatgggacatgcagcgtgtcctacctgcctgtgctgccgggggactacagcattctagtcaagtacaatgaacagcacgtcccaggcagccccttcactgctcgggtcacaggtgacgactccatgcgtatgtcccacctaaaggtcggctctgctgccgacatccccatcaacatctcagagacggatctcagcctgctgacggccactgtggtcccgccctcgggccgggaggagccctgtttgctgaagcggctgcgtaatggccacgtggggatttcattcgtgcccaaggagacgggggagcacctggtgcatgtgaagaaaaatggccagcacgtggccagcagccccatcccggtggtgatcagccagtcggaaattggggatgccagtcgtgttcgggtctctggtcagggccttcacgaaggccacacctttgagcctgcagagtttatcattgatacccgcgatgcaggctatggtgggctcagcctgtccattgagggccccagcaaggtggacatcaacacagaggacctggaggacgggacgtgcagggtcacctactgccccacagagccaggcaactacatcatcaacatcaagtttgccgaccagcacgtgcctggcagccccttctctgtgaaggtgacaggcgagggccgggtgaaagagagcatcacccgcaggcgtcgggctccttcagtggccaacgttggtagtcattgtgacctcagcctgaaaatccctgaaattagcatccaggatatgacagcccaggtgaccagcccatcgggcaagacccatgaggccgagatcgtggaaggggagaaccacacctactgcatccgctttgttcccgctgagatgggcacacacacagtcagcgtgaagtacaagggccagcacgtgcctgggagccccttccagttcaccgtggggcccctaggggaagggggagcccacaaggtccgagctgggggccctggcctggagagagctgaagctggagtgccagccgaattcagtatctggacccgggaagctggtgctggaggcctggccattgctgtcgagggccccagcaaggctgagatctcttttgaggaccgcaaggacggctcctgtggtgtggcttatgtggtccaggagccaggtgactacgaagtctcagtcaagttcaacgaggaacacattcccgacagccccttcgtggtgcctgtggcttctccgtctggcgacgcccgccgcctcactgtttctagccttcaggagtcagggctaaaggtcaaccagccagcctcttttgcagtcagcctgaacggggccaagggggcgatcgatgccaaggtgcacagcccctcaggagccctggaggagtgctatgtcacagaaattgaccaagataagtatgctgtgcgcttcatccctcgggagaatggcgtttacctgattgacgtcaagttcaacggcacccacatccctggaagccccttcaagatccgagttggggagcctgggcatggaggggacccaggcttggtgtctgcttacggagcaggtctggaaggcggtgtcacagggaacccagctgagttcgtcgtgaacacgagcaatgcgggagctggtgccctgtcggtgaccattgacggcccctccaaggtgaagatggattgccaggagtgccctgagggctaccgcgtcacctatacccccatggcacctggcagctacctcatctccatcaagtacggcggcccctaccacattgggggcagccccttcaaggccaaagtcacaggcccccgtctcgtcagcaaccacagcctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagcaggcaacaacatgctgctggtgggggttcatggcccaaggaccccctgcgaggagatcctggtgaagcacgtgggcagccggctctacagcgtgtcctacctgctcaaggacaagggggagtacacactggtggtcaaatggggggacgagcacatcccaggcagcccctaccgcgttgtggtgccctgagtctggggcccgtgccagccggcagcccccaagcctgccccgctacccaagcagccccgccctcttcccctcaaccccggcccaggccgccctggccgcccgcctgtcactgcagccgcccctgccctgtgccgtgctgcgctcacctgcctccccagccagccgctgacctctcggctttcacttgggcagagggagccatttggtggcgctgcttgtcttctttggttctgggaggggtgagggatgggggtcctgtacacaaccacccactagttctcttctccagccaagaggaataaagttttgcttccattct

SEQ ID NO: 737 - DNA, 8435 bp, Homo sapiens
gcgatccgggcgccaccccgcggtcatcggtcaccggtcgctctcaggaacagcagcgcaacctctgctccctgcctcgcctcccgcgcgcctaggtgcctgcgactttaattaaagggccgtcccctcgccgaggctgcagcaccgcccccccggcttctcgcgcctcaaaatgagtagctcccactctcgggcgggccagagcgcagcaggcgcggctccgggcggcggcgtcgacacgcgggacgccgagatgccggccaccgagaaggacctggcggaggacgcgccgtggaagaagatccagcagaacactttcacgcgctggtgcaacgagcacctgaagtgcgtgagcaagcgcatcgccaacctgcagacggacctgagcgacgggctgcggcttatcgcgctgttggaggtgctcagccagaagaagatgcaccgcaagcacaaccagcggcccactttccgccaaatgcagcttgagaacgtgtcggtggcgctcgagttcctggaccgcgagagcatcaaactggtgtccatcgacagcaaggccatcgtggacgggaacctgaagctgatcctgggcctcatctggaccctgatcctgcactactccatctccatgcccatgtgggacgaggaggaggatgaggaggccaagaagcagacccccaagcagaggctcctgggctggatccagaacaagctgccgcagctgcccatcaccaacttcagccgggactggcagagcggccgggccctgggcgccctggtggacagctgtgccccgggcctgtgtcctgactgggactcttgggacgccagcaagcccgttaccaatgcgcgagaggccatgcagcaggcggatgactggctgggcatcccccaggtgatcacccccgaggagattgtggaccccaacgtggacgagcactctgtcatgacctacctgtcccagttccccaaggccaagctgaagccaggggctcccttgcggcccaaactgaacccgaagaaagcccgtgcctacgggccaggcatcgagcccacaggcaacatggtgaagaagcgggcagagttcactgtggagaccagaagtgctggccagggagaggtgctggtgtacgtggaggacccggccggacaccaggaggaggcaaaagtgaccgccaataacgacaagaaccgcaccttctccgtctggtacgtccccgaggtgacggggactcataaggttactgtgctctttgctggccagcacatcgccaagagccccttcgaggtgtacgtggataagtcacagggtgacgccagcaaagtgacagcccaaggtcccggcctggagcccagtggcaacatcgccaacaagaccacctactttgagatctttacggcaggagctggcacgggcgaggtcgaggttgtgatccaggaccccatgggacagaagggcacggtagagcctcagctggaggcccggggcgacagcacataccgctgcagctaccagcccaccatggagggcgtccacaccgtgcacgtcacgtttgccggcgtgcccatccctcgcagcccctacactgtcactgttggccaagcctgtaacccgagtgcctgccgggcggttggccggggcctccagcccaagggtgtgcgggtgaaggagacagctgacttcaaggtgtacacaaagggcgctggcagtggggagctgaaggtcaccgtgaagggccccaagggagaggagcgcgtgaagcagaaggacctgggggatggcgtgtatggcttcgagtattaccccatggtccctggaacctatatcgtcaccatcacgtggggtggtcagaacatcgggcgcagtcccttcgaagtgaaggtgggcaccgagtgtggcaatcagaaggtacgggcctggggccctgggctggagggcggcgtcgttggcaagtcagcagactttgtggtggaggctatcggggacgacgtgggcacgctgggcttctcggtggaagggccatcgcaggctaagatcgaatgtgacgacaagggcgacggctcctgtgatgtgcgctactggccgcaggaggctggcgagtatgccgttcacgtgctgtgcaacagcgaagacatccgcctcagccccttcatggctgacatccgtgacgcgccccaggacttccacccagacagggtgaaggcacgtgggcctggattggagaagacaggtgtggccgtcaacaagccagcagagttcacagtggatgccaagcacggtggcaaggccccacttcgggtccaagtccaggacaatgaaggctgccctgtggaggcgttggtcaaggacaacggcaatggcacttacagctgctcctacgtgcccaggaagccggtgaagcacacagccatggtgtcctggggaggcgtcagcatccccaacagccccttcagggtgaatgtgggagctggcagccaccccaacaaggtcaaagtatacggccccggagtagccaagacagggctcaaggcccacgagcccacctacttcactgtggactgcgccgaggctggccagggggacgtcagcatcggcatcaagtgtgcccctggagtggtaggccccgccgaagctgacatcgacttcgacatcatccgcaatgacaatgacaccttcacggtcaagtacacgccccggggggctggcagctacaccattatggtcctctttgctgaccaggccacgcccaccagccccatccgagtcaaggtggagccctctcatgacgccagtaaggtgaaggccgagggccctggcctcagtcgcactggtgtcgagcttggcaagcccacccacttcacagtaaatgccaaagctgctggcaaaggcaagctggacgtccagttctcaggactcaccaagggggatgcagtgcgagatgtggacatcatcgaccaccatgacaacacctacacagtcaagtacacgcctgtccagcagggtccagtaggcgtcaatgtcacttatggaggggatcccatccctaagagccctttctcagtggcagtatctccaagcctggacctcagcaagatcaaggtgtctggcctgggagagaaggtggacgttggcaaagaccaggagttcacagtcaaatcaaagggtgctggtggtcaaggcaaagtggcatccaagattgtgggcccctcgggtgcagcggtgccctgcaaggtggagccaggcctgggggctgacaacagtgtggtgcgcttcctgccccgtgaggaagggccctatgaggtggaggtgacctatgacggcgtgcccgtgcctggcagcccctttcctctggaagctgtggcccccaccaagcctagcaaggtgaaggcgtttgggccggggctgcagggaggcagtgcgggctcccccgcccgcttcaccatcgacaccaagggcgccggcacaggtggcctgggcctgacggtggagggcccctgtgaggcgcagctcgagtgcttggacaatggggatggcacatgttccgtgtcctacgtgcccaccgagcccggggactacaacatcaacatcctcttcgctgacacccacatccctggctccccattcaaggcccacgtggttccctgctttgacgcatccaaagtcaagtgctcaggccccgggctggagcgggccaccgctggggaggtgggccaattccaagtggactgctcgagcgcgggcagcgcggagctgaccattgagatctgctcggaggcggggcttccggccgaggtgtacatccaggaccacggtgatggcacgcacaccattacctacattcccctctgccccggggcctacaccgtcaccatcaagtacggcggccagcccgtgcccaacttccccagcaagctgcaggtggaacctgcggtggacacttccggtgtccagtgctatgggcctggtattgagggccagggtgtcttccgtgaggccaccactgagttcagtgtggacgcccgggctctgacacagaccggagggccgcacgtcaaggcccgtgtggccaacccctcaggcaacctgacggagacctacgttcaggaccgtggcgatggcatgtacaaagtggagtacacgccttacgaggagggactgcactccgtggacgtgacctatgacggcagtcccgtgcccagcagccccttccaggtgcccgtgaccgagggctgcgacccctcccgggtgcgtgtccacgggccaggcatccaaagtggcaccaccaacaagcccaacaagttcactgtggagaccaggggagctggcacgggcggcctgggcctggctgtagagggcccctccgaggccaagatgtcctgcatggataacaaggacggcagctgctcggtcgagtacatcccttatgaggctggcacctacagcctcaacgtcacctatggtggccatcaagtgccaggcagtcctttcaaggtccctgtgcatgatgtgacagatgcgtccaaggtcaagtgctctgggcccggcctgagcccaggcatggttcgtgccaacctccctcagtccttccaggtggacacaagcaaggctggtgtggccccattgcaggtcaaagtgcaagggcccaaaggcctggtggagccagtggacgtggtagacaacgctgatggcacccagaccgtcaattatgtgcccagccgagaagggccctacagcatctcagtactgtatggagatgaagaggtaccccggagccccttcaaggtcaaggtgctgcctactcatgatgccagcaaggtgaaggccagtggccccgggctcaacaccactggcgtgcctgccagcctgcccgtggagttcaccatcgatgcaaaggacgccggggagggcctgctggctgtccagatcacggatcccgaaggcaagccgaagaagacacacatccaagacaaccatgacggcacgtatacagtggcctacgtgccagacgtgacaggtcgctacaccatcctcatcaagtacggtggtgacgagatccccttctccccgtaccgcgtgcgtgccgtgcccaccggggacgccagcaagtgcactgtcacagtgtcaatcggaggtcacgggctaggtgctggcatcggccccaccattcagattggggaggagacggtgatcactgtggacactaaggcggcaggcaaaggcaaagtgacgtgcaccgtgtgcacgcctgatggctcagaggtggatgtggacgtggtggagaatgaggacggcactttcgacatcttctacacggccccccagccgggcaaatacgtcatctgtgtgcgctttggtggcgagcacgtgcccaacagccccttccaagtgacggctctggctggggaccagccctcggtgcagccccctctacggtctcagcagctggccccacagtacacctacgcccagggcggccagcagacttgggccccggagaggcccctggtgggtgtcaatgggctggatgtgaccagcctgaggccctttgaccttgtcatccccttcaccatcaagaagggcgagatcacaggggaggttcggatgccctcaggcaaggtggcgcagcccaccatcactgacaacaaagacggcaccgtgaccgtgcggtatgcacccagcgaggctggcctgcacgagatggacatccgctatgacaacatgcacatcccaggaagccccttgcagttctatgtggattacgtcaactgtggccatgtcactgcctatgggcctggcctcacccatggagtagtgaacaagcctgccaccttcaccgtcaacaccaaggatgcaggagaggggggcctgtctctggccattgagggcccgtccaaagcagaaatcagctgcactgacaaccaggatgggacatgcagcgtgtcctacctgcctgtgctgccgggggactacagcattctagtcaagtacaatgaacagcacgtcccaggcagccccttcactgctcgggtcacaggtgacgactccatgcgtatgtcccacctaaaggtcggctctgctgccgacatccccatcaacatctcagagacggatctcagcctgctgacggccactgtggtcccgccctcgggccgggaggagccctgtttgctgaagcggctgcgtaatggccacgtggggatttcattcgtgcccaaggagacgggggagcacctggtgcatgtgaagaaaaatggccagcacgtggccagcagccccatcccggtggtgatcagccagtcggaaattggggatgccagtcgtgttcgggtctctggtcagggccttcacgaaggccacacctttgagcctgcagagtttatcattgatacccgcgatgcaggctatggtgggctcagcctgtccattgagggccccagcaaggtggacatcaacacagaggacctggaggacgggacgtgcagggtcacctactgccccacagagccaggcaactacatcatcaacatcaagtttgccgaccagcacgtgcctggcagccccttctctgtgaaggtgacaggcgagggccgggtgaaagagagcatcacccgcaggcgtcgggctccttcagtggccaacgttggtagtcattgtgacctcagcctgaaaatccctgaaattagcatccaggatatgacagcccaggtgaccagcccatcgggcaagacccatgaggccgagatcgtggaaggggagaaccacacctactgcatccgctttgttcccgctgagatgggcacacacacagtcagcgtgaagtacaagggccagcacgtgcctgggagccccttccagttcaccgtggggcccctaggggaagggggagcccacaaggtccgagctgggggccctggcctggagagagctgaagctggagtgccagccgaattcagtatctggacccgggaagctggtgctggaggcctggccattgctgtcgagggccccagcaaggctgagatctcttttgaggaccgcaaggacggctcctgtggtgtggcttatgtggtccaggagccaggtgactacgaagtctcagtcaagttcaacgaggaacacattcccgacagccccttcgtggtgcctgtggcttctccgtctggcgacgcccgccgcctcactgtttctagccttcaggagtcagggctaaaggtcaaccagccagcctcttttgcagtcagcctgaacggggccaagggggcgatcgatgccaaggtgcacagcccctcaggagccctggaggagtgctatgtcacagaaattgaccaagataagtatgctgtgcgcttcatccctcgggagaatggcgtttacctgattgacgtcaagttcaacggcacccacatccctggaagccccttcaagatccgagttggggagcctgggcatggaggggacccaggcttggtgtctgcttacggagcaggtctggaaggcggtgtcacagggaacccagctgagttcgtcgtgaacacgagcaatgcgggagctggtgccctgtcggtgaccattgacggcccctccaaggtgaagatggattgccaggagtgccctgagggctaccgcgtcacctatacccccatggcacctggcagctacctcatctccatcaagtacggcggcccctaccacattgggggcagccccttcaaggccaaagtcacaggcccccgtctcgtcagcaaccacagcctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagcaggcaacaacatgctgctggtgggggttcatggcccaaggaccccctgcgaggagatcctggtgaagcacgtgggcagccggctctacagcgtgtcctacctgctcaaggacaagggggagtacacactggtggtcaaatggggggacgagcacatcccaggcagcccctaccgcgttgtggtgccctgagtctggggcccgtgccagccggcagcccccaagcctgccccgctacccaagcagccccgccctcttcccctcaaccccggcccaggccgccctggccgcccgcctgtcactgcagccgcccctgccctgtgccgtgctgcgctcacctgcctccccagccagccgctgacctctcggctttcacttgggcagagggagccatttggtggcgctgcttgtcttctttggttctgggaggggtgagggatgggggtcctgtacacaaccacccactagttctcttctccagccaagaggaataaagttttgcttccattct

SEQ ID NO: 738 - DNA, 8206 bp, Homo sapiens
gcgatccgggcgccaccccgcggtcatcggtcaccggtcgctctcaggaacagcagcgcaacctctgctccctgcctcgcctcccgcgcgcctaggtgcctgcgactttaattaaagggccgtcccctcgccgaggctgcagcaccgcccccccggcttctcgcgcctcaaaatgagtagctcccactctcgggcgggccagagcgcagcaggcgcggctccgggcggcggcgtcgacacgcgggacgccgagatgccggccaccgagaaggacctggcggaggacgcgccgtggaagaagatccagcagaacactttcacgcgctggtgcaacgagcacctgaagtgcgtgagcaagcgcatcgccaacctgcagacggacctgagcgacgggctgcggcttatcgcgctgttggaggtgctcagccagaagaagatgcaccgcaagcacaaccagcggcccactttccgccaaatgcagcttgagaacgtgtcggtggcgctcgagttcctggaccgcgagagcatcaaactggtgtccatcgacagcaaggccatcgtggacgggaacctgaagctgatcctgggcctcatctggaccctgatcctgcactactccatctccatgcccatgtgggacgaggaggaggatgaggaggccaagaagcagacccccaagcagaggctcctgggctggatccagaacaagctgccgcagctgcccatcaccaacttcagccgggactggcagagcggccgggccctgggcgccctggtggacagctgtgccccgggcctgtgtcctgactgggactcttgggacgccagcaagcccgttaccaatgcgcgagaggccatgcagcaggcggatgactggctgggcatcccccaggtgatcacccccgaggagattgtggaccccaacgtggacgagcactctgtcatgacctacctgtcccagttccccaaggccaagctgaagccaggggctcccttgcggcccaaactgaacccgaagaaagcccgtgcctacgggccaggcatcgagcccacaggcaacatggtgaagaagcgggcagagttcactgtggagaccagaagtgctggccagggagaggtgctggtgtacgtggaggacccggccggacaccaggaggaggcaaaagtgaccgccaataacgacaagaaccgcaccttctccgtctggtacgtccccgaggtgacggggactcataaggttactgtgctctttgctggccagcacatcgccaagagccccttcgaggtgtacgtggataagtcacagggtgacgccagcaaagtgacagcccaaggtcccggcctggagcccagtggcaacatcgccaacaagaccacctactttgagatctttacggcaggagctggcacgggcgaggtcgaggttgtgatccaggaccccatgggacagaagggcacggtagagcctcagctggaggcccggggcgacagcacataccgctgcagctaccagcccaccatggagggcgtccacaccgtgcacgtcacgtttgccggcgtgcccatccctcgcagcccctacactgtcactgttggccaagcctgtaacccgagtgcctgccgggcggttggccggggcctccagcccaagggtgtgcgggtgaaggagacagctgacttcaaggtgtacacaaagggcgctggcagtggggagctgaaggtcaccgtgaagggccccaagggagaggagcgcgtgaagcagaaggacctgggggatggcgtgtatggcttcgagtattaccccatggtccctggaacctatatcgtcaccatcacgtggggtggtcagaacatcgggcgcagtcccttcgaagtgaaggtgggcaccgagtgtggcaatcagaaggtacgggcctggggccctgggctggagggcggcgtcgttggcaagtcagcagactttgtggtggaggctatcggggacgacgtgggcacgctgggcttctcggtggaagggccatcgcaggctaagatcgaatgtgacgacaagggcgacggctcctgtgatgtgcgctactggccgcaggaggctggcgagtatgccgttcacgtgctgtgcaacagcgaagacatccgcctcagccccttcatggctgacatccgtgacgcgccccaggacttccacccagacagggtgaaggcacgtgggcctggattggagaagacaggtgtggccgtcaacaagccagcagagttcacagtggatgccaagcacggtggcaaggccccacttcgggtccaagtccaggacaatgaaggctgccctgtggaggcgttggtcaaggacaacggcaatggcacttacagctgctcctacgtgcccaggaagccggtgaagcacacagccatggtgtcctggggaggcgtcagcatccccaacagccccttcagggtgaatgtgggagctggcagccaccccaacaaggtcaaagtatacggccccggagtagccaagacagggctcaaggcccacgagcccacctacttcactgtggactgcgccgaggctggccagggggacgtcagcatcggcatcaagtgtgcccctggagtggtaggccccgccgaagctgacatcgacttcgacatcatccgcaatgacaatgacaccttcacggtcaagtacacgccccggggggctggcagctacaccattatggtcctctttgctgaccaggccacgcccaccagccccatccgagtcaaggtggagccctctcatgacgccagtaaggtgaaggccgagggccctggcctcagtcgcactggtgtcgagcttggcaagcccacccacttcacagtaaatgccaaagctgctggcaaaggcaagctggacgtccagttctcaggactcaccaagggggatgcagtgcgagatgtggacatcatcgaccaccatgacaacacctacacagtcaagtacacgcctgtccagcagggtccagtaggcgtcaatgtcacttatggaggggatcccatccctaagagccctttctcagtggcagtatctccaagcctggacctcagcaagatcaaggtgtctggcctgggagagaaggtggacgttggcaaagaccaggagttcacagtcaaatcaaagggtgctggtggtcaaggcaaagtggcatccaagattgtgggcccctcgggtgcagcggtgccctgcaaggtggagccaggcctgggggctgacaacagtgtggtgcgcttcctgccccgtgaggaagggccctatgaggtggaggtgacctatgacggcgtgcccgtgcctggcagcccctttcctctggaagctgtggcccccaccaagcctagcaaggtgaaggcgtttgggccggggctgcagggaggcagtgcgggctcccccgcccgcttcaccatcgacaccaagggcgccggcacaggtggcctgggcctgacggtggagggcccctgtgaggcgcagctcgagtgcttggacaatggggatggcacatgttccgtgtcctacgtgcccaccgagcccggggactacaacatcaacatcctcttcgctgacacccacatccctggctccccattcaaggcccacgtggttccctgctttgacgcatccaaagtcaagtgctcaggccccgggctggagcgggccaccgctggggaggtgggccaattccaagtggactgctcgagcgcgggcagcgcggagctgaccattgagatctgctcggaggcggggcttccggccgaggtgtacatccaggaccacggtgatggcacgcacaccattacctacattcccctctgccccggggcctacaccgtcaccatcaagtacggcggccagcccgtgcccaacttccccagcaagctgcaggtggaacctgcggtggacacttccggtgtccagtgctatgggcctggtattgagggccagggtgtcttccgtgaggccaccactgagttcagtgtggacgcccgggctctgacacagaccggagggccgcacgtcaaggcccgtgtggccaacccctcaggcaacctgacggagacctacgttcaggaccgtggcgatggcatgtacaaagtggagtacacgccttacgaggagggactgcactccgtggacgtgacctatgacggcagtcccgtgcccagcagccccttccaggtgcccgtgaccgagggctgcgacccctcccgggtgcgtgtccacgggccaggcatccaaagtggcaccaccaacaagcccaacaagttcactgtggagaccaggggagctggcacgggcggcctgggcctggctgtagagggcccctccgaggccaagatgtcctgcatggataacaaggacggcagctgctcggtcgagtacatcccttatgaggctggcacctacagcctcaacgtcacctatggtggccatcaagtgccaggcagtcctttcaaggtccctgtgcatgatgtgacagatgcgtccaaggtcaagtgctctgggcccggcctgagcccaggcatggttcgtgccaacctccctcagtccttccaggtggacacaagcaaggctggtgtggccccattgcaggtcaaagtgcaagggcccaaaggcctggtggagccagtggacgtggtagacaacgctgatggcacccagaccgtcaattatgtgcccagccgagaagggccctacagcatctcagtactgtatggagatgaagaggtaccccggagccccttcaaggtcaaggtgctgcctactcatgatgccagcaaggtgaaggccagtggccccgggctcaacaccactggcgtgcctgccagcctgcccgtggagttcaccatcgatgcaaaggacgccggggagggcctgctggctgtccagatcacggatcccgaaggcaagccgaagaagacacacatccaagacaaccatgacggcacgtatacagtggcctacgtgccagacgtgacaggtcgctacaccatcctcatcaagtacggtggtgacgagatccccttctccccgtaccgcgtgcgtgccgtgcccaccggggacgccagcaagtgcactgtcacagtgtcaatcggaggtcacgggctaggtgctggcatcggccccaccattcagattggggaggagacggtgatcactgtggacactaaggcggcaggcaaaggcaaagtgacgtgcaccgtgtgcacgcctgatggctcagaggtggatgtggacgtggtggagaatgaggacggcactttcgacatcttctacacggccccccagccgggcaaatacgtcatctgtgtgcgctttggtggcgagcacgtgcccaacagccccttccaagtgacggctctggctggggaccagccctcggtgcagccccctctacggtctcagcagctggccccacagtacacctacgcccagggcggccagcagacttgggccccggagaggcccctggtgggtgtcaatgggctggatgtgaccagcctgaggccctttgaccttgtcatccccttcaccatcaagaagggcgagatcacaggggaggttcggatgccctcaggcaaggtggcgcagcccaccatcactgacaacaaagacggcaccgtgaccgtgcggtatgcacccagcgaggctggcctgcacgagatggacatccgctatgacaacatgcacatcccaggaagccccttgcagttctatgtggattacgtcaactgtggccatgtcactgcctatgggcctggcctcacccatggagtagtgaacaagcctgccaccttcaccgtcaacaccaaggatgcaggagaggggggcctgtctctggccattgagggcccgtccaaagcagaaatcagctgcactgacaaccaggatgggacatgcagcgtgtcctacctgcctgtgctgccgggggactacagcattctagtcaagtacaatgaacagcacgtcccaggcagccccttcactgctcgggtcacaggtgacgactccatgcgtatgtcccacctaaaggtcggctctgctgccgacatccccatcaacatctcagagacggatctcagcctgctgacggccactgtggtcccgccctcgggccgggaggagccctgtttgctgaagcggctgcgtaatggccacgtggggatttcattcgtgcccaaggagacgggggagcacctggtgcatgtgaagaaaaatggccagcacgtggccagcagccccatcccggtggtgatcagccagtcggaaattggggatgccagtcgtgttcgggtctctggtcagggccttcacgaaggccacacctttgagcctgcagagtttatcattgatacccgcgatgcaggctatggtgggctcagcctgtccattgagggccccagcaaggtggacatcaacacagaggacctggaggacgggacgtgcagggtcacctactgccccacagagccaggcaactacatcatcaacatcaagtttgccgaccagcacgtgcctggcagccccttctctgtgaaggtgacaggcgagggccgggtgaaagagagcatcacccgcaggcgtcgggctccttcagtggccaacgttggtagtcattgtgacctcagcctgaaaatccctgaaattagcatccaggatatgacagcccaggtgaccagcccatcgggcaagacccatgaggccgagatcgtggaaggggagaaccacacctactgcatccgctttgttcccgctgagatgggcacacacacagtcagcgtgaagtacaagggccagcacgtgcctgggagccccttccagttcaccgtggggcccctaggggaagggggagcccacaaggtccgagctgggggccctggcctggagagagctgaagctggagtgccagccgaattcagtatctggacccgggaagctggtgctggaggcctggccattgctgtcgagggccccagcaaggctgagatctcttttgaggaccgcaaggacggctcctgtggtgtggcttatgtggtccaggagccaggtatacgaagtctcagtcaagttcaacgaggaacacattcccgacagccccttcgtggtgcctgtggcttctccgtctggcgacgcccgccgcctcactgtttctagccttcaggagtcagggctaaaggtcaaccagccagcctcttttgcagtcagcctgaacggggccaagggggcgatcgatgccaaggtgcacagcccctcaggagccctggaggagtgctatgtcacagaaattgaccaagataagtatgctgtgcgcttcatccctcgggagaatggcgtttacctgattgacgtcaagttcaacggcacccacatccctggaagccccttcaagatccgagttggggagcctgggcatggaggggacccaggcttggtgtctgcttacggagcaggtctggaaggcggtgtcacagggaacccagctgagttcgtcgtgaacacgagcaatgcgggagctggtgccctgtcggtgaccattgacggcccctccaaggtgaagatggattgccaggagtgccctgagggctaccgcgtcacctatacccccatggcacctggcagctacctcatctccatcaagtacggcggcccctaccacattgggggcagccccttcaaggccaaagtcacaggcccccgtctcgtcagcaaccacagcctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagcaggcaacaacatgctgctggtgggggttcatggcccaaggaccccctgcgaggagatcctggtgaagcacgtgggcagccggctctacagcgtgtcctacctgcgctcacctgcctccccagccagccgctgacctctcggctttcacttgggcagagggagccatttggtggcgctgcttgtcttctttggttctgggaggggtgagggatgggggtcctgtacacaaccacccactagttctcttctccagccaagaggaataaagttttgcttccattc

SEQ ID NO: 739 - DNA, 8850 bp, Homo sapiens
gcgatccgggcgccaccccgcggtcatcggtcaccggtcgctctcaggaacagcagcgcaacctctgctccctgcctcgcctcccgcgcgcctaggtgcctgcgactttaattaaagggccgtcccctcgccgaggctgcagcaccgcccccccggcttctcgcgcctcaaaatgagtagctcccactctcgggcgggccagagcgcagcaggcgcggctccgggcggcggcgtcgacacgcgggacgccgagatgccggccaccgagaaggacctggcggaggacgcgccgtggaagaagatccagcagaacactttcacgcgctggtgcaacgagcacctgaagtgcgtgagcaagcgcatcgccaacctgcagacggacctgagcgacgggctgcggcttatcgcgctgttggaggtgctcagccagaagaagatgcaccgcaagcacaaccagcggcccactttccgccaaatgcagcttgagaacgtgtcggtggcgctcgagttcctggaccgcgagagcatcaaactggtgtccatcgacagcaaggccatcgtggacgggaacctgaagctgatcctgggcctcatctggaccctgatcctgcactactccatctccatgcccatgtgggacgaggaggaggatgaggaggccaagaagcagacccccaagcagaggctcctgggctggatccagaacaagctgccgcagctgcccatcaccaacttcagccgggactggcagagcggccgggccctgggcgccctggtggacagctgtgccccgggcctgtgtcctgactgggactcttgggacgccagcaagcccgttaccaatgcgcgagaggccatgcagcaggcggatgactggctgggcatcccccaggtgatcacccccgaggagattgtggaccccaacgtggacgagcactctgtcatgacctacctgtcccagttccccaaggccaagctgaagccaggggctcccttgcggcccaaactgaacccgaagaaagcccgtgcctacgggccaggcatcgagcccacaggcaacatggtgaagaagcgggcagagttcactgtggagaccagaagtgctggccagggagaggtgctggtgtacgtggaggacccggccggacaccaggaggaggcaaaagtgaccgccaataacgacaagaaccgcaccttctccgtctggtacgtccccgaggtgacggggactcataaggttactgtgctctttgctggccagcacatcgccaagagccccttcgaggtgtacgtggataagtcacagggtgacgccagcaaagtgacagcccaaggtcccggcctggagcccagtggcaacatcgccaacaagaccacctactttgagatctttacggcaggagctggcacgggcgaggtcgaggttgtgatccaggaccccatgggacagaagggcacggtagagcctcagctggaggcccggggcgacagcacataccgctgcagctaccagcccaccatggagggcgtccacaccgtgcacgtcacgtttgccggcgtgcccatccctcgcagcccctacactgtcactgttggccaagcctgtaacccgagtgcctgccgggcggttggccggggcctccagcccaagggtgtgcgggtgaaggagacagctgacttcaaggtgtacacaaagggcgctggcagtggggagctgaaggtcaccgtgaagggccccaagggagaggagcgcgtgaagcagaaggacctgggggatggcgtgtatggcttcgagtattaccccatggtccctggaacctatatcgtcaccatcacgtggggtggtcagaacatcgggcgcagtcccttcgaagtgaaggtgggcaccgagtgtggcaatcagaaggtacgggcctggggccctgggctggagggcggcgtcgttggcaagtcagcagactttgtggtggaggctatcggggacgacgtgggcacgctgggcttctcggtggaagggccatcgcaggctaagatcgaatgtgacgacaagggcgacggctcctgtgatgtgcgctactggccgcaggaggctggcgagtatgccgttcacgtgctgtgcaacagcgaagacatccgcctcagccccttcatggctgacatccgtgacgcgccccaggacttccacccagacagggtgaaggcacgtgggcctggattggagaagacaggtgtggccgtcaacaagccagcagagttcacagtggatgccaagcacggtggcaaggccccacttcgggtccaagtccaggacaatgaaggctgccctgtggaggcgttggtcaaggacaacggcaatggcacttacagctgctcctacgtgcccaggaagccggtgaagcacacagccatggtgtcctggggaggcgtcagcatccccaacagccccttcagggtgaatgtgggagctggcagccaccccaacaaggtcaaagtatacggccccggagtagccaagacagggctcaaggcccacgagcccacctacttcactgtggactgcgccgaggctggccagggggacgtcagcatcggcatcaagtgtgcccctggagtggtaggccccgccgaagctgacatcgacttcgacatcatccgcaatgacaatgacaccttcacggtcaagtacacgccccggggggctggcagctacaccattatggtcctctttgctgaccaggccacgcccaccagccccatccgagtcaaggtggagccctctcatgacgccagtaaggtgaaggccgagggccctggcctcagtcgcactggtgtcgagcttggcaagcccacccacttcacagtaaatgccaaagctgctggcaaaggcaagctggacgtccagttctcaggactcaccaagggggatgcagtgcgagatgtggacatcatcgaccaccatgacaacacctacacagtcaagtacacgcctgtccagcagggtccagtaggcgtcaatgtcacttatggaggggatcccatccctaagagccctttctcagtggcagtatctccaagcctggacctcagcaagatcaaggtgtctggcctgggagagaaggtggacgttggcaaagaccaggagttcacagtcaaatcaaagggtgctggtggtcaaggcaaagtggcatccaagattgtgggcccctcgggtgcagcggtgccctgcaaggtggagccaggcctgggggctgacaacagtgtggtgcgcttcctgccccgtgaggaagggccctatgaggtggaggtgacctatgacggcgtgcccgtgcctggcagcccctttcctctggaagctgtggcccccaccaagcctagcaaggtgaaggcgtttgggccggggctgcagggaggcagtgcgggctcccccgcccgcttcaccatcgacaccaagggcgccggcacaggtggcctgggcctgacggtggagggcccctgtgaggcgcagctcgagtgcttggacaatggggatggcacatgttccgtgtcctacgtgcccaccgagcccggggactacaacatcaacatcctcttcgctgacacccacatccctggctccccattcaaggcccacgtggttccctgctttgacgcatccaaagtcaagtgctcaggccccgggctggagcgggccaccgctggggaggtgggccaattccaagtggactgctcgagcgcgggcagcgcggagctgaccattgagatctgctcggaggcggggcttccggccgaggtgtacatccaggaccacggtgatggcacgcacaccattacctacattcccctctgccccggggcctacaccgtcaccatcaagtacggcggccagcccgtgcccaacttccccagcaagctgcaggtggaacctgcggtggacacttccggtgtccagtgctatgggcctggtattgagggccagggtgtcttccgtgaggccaccactgagttcagtgtggacgcccgggctctgacacagaccggagggccgcacgtcaaggcccgtgtggccaacccctcaggcaacctgacggagacctacgttcaggaccgtggcgatggcatgtacaaagtggagtacacgccttacgaggagggactgcactccgtggacgtgacctatgacggcagtcccgtgcccagcagccccttccaggtgcccgtgaccgagggctgcgacccctcccgggtgcgtgtccacgggccaggcatccaaagtggcaccaccaacaagcccaacaagttcactgtggagaccaggggagctggcacgggcggcctgggcctggctgtagagggcccctccgaggccaagatgtcctgcatggataacaaggacggcagctgctcggtcgagtacatcccttatgaggctggcacctacagcctcaacgtcacctatggtggccatcaagtgccaggcagtcctttcaaggtccctgtgcatgatgtgacagatgcgtccaaggtcaagtgctctgggcccggcctgagcccaggcatggttcgtgccaacctccctcagtccttccaggtggacacaagcaaggctggtgtggccccattgcaggtcaaagtgcaagggcccaaaggtgagtgtttgcatgcctggagccaggggtcaggagggcagtgtcctgtttgagggccgggaaaggaaactggaggcccaaagtgaggaccagagtgcagaggtggtgcaagtgtgtaggtgtttttggaagagcctcaggtgacagtgcagccaggtgggggacttggaggaggtagagcagatgggactggtcactgagcagatgtggcaggaaggcaggcaggcaagggtcccagctggcacccagatgggtgtctttcgtgccagagggggtcaaggccattcccagggtcgggtggatgaggataaagcgaggtctaggcctggggctgggtcctggccgtccagtgtggtggggtaggaatggaggcccaggagactagctgatgctctgtccctggggctggggccaggcctggtggagccagtggacgtggtagacaacgctgatggcacccagaccgtcaattatgtgcccagccgagaagggccctacagcatctcagtactgtatggagatgaagaggtaccccggagccccttcaaggtcaaggtgctgcctactcatgatgccagcaaggtgaaggccagtggccccgggctcaacaccactggcgtgcctgccagcctgcccgtggagttcaccatcgatgcaaaggacgccggggagggcctgctggctgtccagatcacggatcccgaaggcaagccgaagaagacacacatccaagacaaccatgacggcacgtatacagtggcctacgtgccagacgtgacaggtcgctacaccatcctcatcaagtacggtggtgacgagatccccttctccccgtaccgcgtgcgtgccgtgcccaccggggacgccagcaagtgcactgtcacagtgtcaatcggaggtcacgggctaggtgctggcatcggccccaccattcagattggggaggagacggtgatcactgtggacactaaggcggcaggcaaaggcaaagtgacgtgcaccgtgtgcacgcctgatggctcagaggtggatgtggacgtggtggagaatgaggacggcactttcgacatcttctacacggccccccagccgggcaaatacgtcatctgtgtgcgctttggtggcgagcacgtgcccaacagccccttccaagtgacggctctggctggggaccagccctcggtgcagccccctctacggtctcagcagctggccccacagtacacctacgcccagggcggccagcagacttgggccccggagaggcccctggtgggtgtcaatgggctggatgtgaccagcctgaggccctttgaccttgtcatccccttcaccatcaagaagggcgagatcacaggggaggttcggatgccctcaggcaaggtggcgcagcccaccatcactgacaacaaagacggcaccgtgaccgtgcggtatgcacccagcgaggctggcctgcacgagatggacatccgctatgacaacatgcacatcccaggaagccccttgcagttctatgtggattacgtcaactgtggccatgtcactgcctatgggcctggcctcacccatggagtagtgaacaagcctgccaccttcaccgtcaacaccaaggatgcaggagaggggggcctgtctctggccattgagggcccgtccaaagcagaaatcagctgcactgacaaccaggatgggacatgcagcgtgtcctacctgcctgtgctgccgggggactacagcattctagtcaagtacaatgaacagcacgtcccaggcagccccttcactgctcgggtcacaggtgacgactccatgcgtatgtcccacctaaaggtcggctctgctgccgacatccccatcaacatctcagagacggatctcagcctgctgacggccactgtggtcccgccctcgggccgggaggagccctgtttgctgaagcggctgcgtaatggccacgtggggatttcattcgtgcccaaggagacgggggagcacctggtgcatgtgaagaaaaatggccagcacgtggccagcagccccatcccggtggtgatcagccagtcggaaattggggatgccagtcgtgttcgggtctctggtcagggccttcacgaaggccacacctttgagcctgcagagtttatcattgatacccgcgatgcaggctatggtgggctcagcctgtccattgagggccccagcaaggtggacatcaacacagaggacctggaggacgggacgtgcagggtcacctactgccccacagagccaggcaactacatcatcaacatcaagtttgccgaccagcacgtgcctggcagccccttctctgtgaaggtgacaggcgagggccgggtgaaagagagcatcacccgcaggcgtcgggctccttcagtggccaacgttggtagtcattgtgacctcagcctgaaaatccctgaaattagcatccaggatatgacagcccaggtgaccagcccatcgggcaagacccatgaggccgagatcgtggaaggggagaaccacacctactgcatccgctttgttcccgctgagatgggcacacacacagtcagcgtgaagtacaagggccagcacgtgcctgggagccccttccagttcaccgtggggcccctaggggaagggggagcccacaaggtccgagctgggggccctggcctggagagagctgaagctggagtgccagccgaattcagtatctggacccgggaagctggtgctggaggcctggccattgctgtcgagggccccagcaaggctgagatctcttttgaggaccgcaaggacggctcctgtggtgtggcttatgtggtccaggagccaggtgactacgaagtctcagtcaagttcaacgaggaacacattcccgacagccccttcgtggtgcctgtggcttctccgtctggcgacgcccgccgcctcactgtttctagccttcaggagtcagggctaaaggtcaaccagccagcctcttttgcagtcagcctgaacggggccaagggggcgatcgatgccaaggtgcacagcccctcaggagccctggaggagtgctatgtcacagaaattgaccaagataagtatgctgtgcgcttcatccctcgggagaatggcgtttacctgattgacgtcaagttcaacggcacccacatccctggaagccccttcaagatccgagttggggagcctgggcatggaggggacccaggcttggtgtctgcttacggagcaggtctggaaggcggtgtcacagggaacccagctgagttcgtcgtgaacacgagcaatgcgggagctggtgccctgtcggtgaccattgacggcccctccaaggtgaagatggattgccaggagtgccctgagggctaccgcgtcacctatacccccatggcacctggcagctacctcatctccatcaagtacggcggcccctaccacattgggggcagccccttcaaggccaaagtcacaggcccccgtctcgtcagcaaccacagcctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagcaggcaacaacatgctgctggtgggggttcatggcccaaggaccccctgcgaggagatcctggtgaagcacgtgggcagccggctctacagcgtgtcctacctgctcaaggacaagggggagtacacactggtggtcaaatggggggacgagcacatcccaggcagcccctaccgcgttgtggtgccctgagtctggggcccgtgccagccggcagcccccaagcctgccccgctacccaagcagccccgccctcttcccctcaaccccggcccaggccgccctggccgcccgcctgtcactgcagccgcccctgccctgtgccgtgctgcgctcacctgcctccccagccagccgctgacctctcggctttcacttgggcagagggagccatttggtggcgctgcttgtcttctttggttctgggaggggtgagggatgggggtcctgtacacaaccacccactagttctcttctccagccaagaggaataaagttttgcttccattct

SEQ ID NO: 740 - DNA, 9448 bp, Homo sapiens
gcgatccgggcgccaccccgcggtcatcggtcaccggtcgctctcaggaacagcagcgcaacctctgctccctgcctcgcctcccgcgcgcctaggtgcctgcgactttaattaaagggccgtcccctcgccgaggctgcagcaccgcccccccggcttctcgcgcctcaaaatgagtagctcccactctcgggcgggccagagcgcagcaggcgcggctccgggcggcggcgtcgacacgcgggacgccgagatgccggccaccgagaaggacctggcggaggacgcgccgtggaagaagatccagcagaacactttcacgcgctggtgcaacgagcacctgaagtgcgtgagcaagcgcatcgccaacctgcagacggacctgagcgacgggctgcggcttatcgcgctgttggaggtgctcagccagaagaagatgcaccgcaagcacaaccagcggcccactttccgccaaatgcagcttgagaacgtgtcggtggcgctcgagttcctggaccgcgagagcatcaaactggtgtccatcgacagcaaggccatcgtggacgggaacctgaagctgatcctgggcctcatctggaccctgatcctgcactactccatctccatgcccatgtgggacgaggaggaggatgaggaggccaagaagcagacccccaagcagaggctcctgggctggatccagaacaagctgccgcagctgcccatcaccaacttcagccgggactggcagagcggccgggccctgggcgccctggtggacagctgtgccccgggcctgtgtcctgactgggactcttgggacgccagcaagcccgttaccaatgcgcgagaggccatgcagcaggcggatgactggctgggcatcccccaggtgatcacccccgaggagattgtggaccccaacgtggacgagcactctgtcatgacctacctgtcccagttccccaaggccaagctgaagccaggggctcccttgcggcccaaactgaacccgaagaaagcccgtgcctacgggccaggcatcgagcccacaggcaacatggtgaagaagcgggcagagttcactgtggagaccagaagtgctggccagggagaggtgctggtgtacgtggaggacccggccggacaccaggaggaggcaaaagtgaccgccaataacgacaagaaccgcaccttctccgtctggtacgtccccgaggtgacggggactcataaggttactgtgctctttgctggccagcacatcgccaagagccccttcgaggtgtacgtggataagtcacagggtgacgccagcaaagtgacagcccaaggtcccggcctggagcccagtggcaacatcgccaacaagaccacctactttgagatctttacggcaggagctggcacgggcgaggtcgaggttgtgatccaggaccccatgggacagaagggcacggtagagcctcagctggaggcccggggcgacagcacataccgctgcagctaccagcccaccatggagggcgtccacaccgtgcacgtcacgtttgccggcgtgcccatccctcgcagcccctacactgtcactgttggccaagcctgtaacccgagtgcctgccgggcggttggccggggcctccagcccaagggtgtgcgggtgaaggagacagctgacttcaaggtgtacacaaagggcgctggcagtggggagctgaaggtcaccgtgaagggccccaagggagaggagcgcgtgaagcagaaggacctgggggatggcgtgtatggcttcgagtattaccccatggtccctggaacctatatcgtcaccatcacgtggggtggtcagaacatcgggcgcagtcccttcgaagtgaaggtgggcaccgagtgtggcaatcagaaggtacgggcctggggccctgggctggagggcggcgtcgttggcaagtcagcagactttgtggtggaggctatcggggacgacgtgggcacgctgggcttctcggtggaagggccatcgcaggctaagatcgaatgtgacgacaagggcgacggctcctgtgatgtgcgctactggccgcaggaggctggcgagtatgccgttcacgtgctgtgcaacagcgaagacatccgcctcagccccttcatggctgacatccgtgacgcgccccaggacttccacccagacagggtgaaggcacgtgggcctggattggagaagacaggtgtggccgtcaacaagccagcagagttcacagtggatgccaagcacggtggcaaggccccacttcgggtccaagtccaggacaatgaaggctgccctgtggaggcgttggtcaaggacaacggcaatggcacttacagctgctcctacgtgcccaggaagccggtgaagcacacagccatggtgtcctggggaggcgtcagcatccccaacagccccttcagggtgaatgtgggagctggcagccaccccaacaaggtcaaagtatacggccccggagtagccaagacagggctcaaggcccacgagcccacctacttcactgtggactgcgccgaggctggccagggggacgtcagcatcggcatcaagtgtgcccctggagtggtaggccccgccgaagctgacatcgacttcgacatcatccgcaatgacaatgacaccttcacggtcaagtacacgccccggggggctggcagctacaccattatggtcctctttgctgaccaggccacgcccaccagccccatccgagtcaaggtggagccctctcatgacgccagtaaggtgaaggccgagggccctggcctcagtcgcactggtgtcgagcttggcaagcccacccacttcacagtaaatgccaaagctgctggcaaaggcaagctggacgtccagttctcaggactcaccaagggggatgcagtgcgagatgtggacatcatcgaccaccatgacaacacctacacagtcaagtacacgcctgtccagcagggtccagtaggcgtcaatgtcacttatggaggggatcccatccctaagagccctttctcagtggcagtatctccaagcctggacctcagcaagatcaaggtgtctggcctgggagagaaggtggacgttggcaaagaccaggagttcacagtcaaatcaaagggtgctggtggtcaaggcaaagtggcatccaagattgtgggcccctcgggtgcagcggtgccctgcaaggtggagccaggcctgggggctgacaacagtgtggtgcgcttcctgccccgtgaggaagggccctatgaggtggaggtgacctatgacggcgtgcccgtgcctggcagcccctttcctctggaagctgtggcccccaccaagcctagcaaggtgaaggcgtttgggccggggctgcagggaggcagtgcgggctcccccgcccgcttcaccatcgacaccaagggcgccggcacaggtggcctgggcctgacggtggagggcccctgtgaggcgcagctcgagtgcttggacaatggggatggcacatgttccgtgtcctacgtgcccaccgagcccggggactacaacatcaacatcctcttcgctgacacccacatccctggctccccattcaaggcccacgtggttccctgctttgacgcatccaaagtcaagtgctcaggccccgggctggagcgggccaccgctggggaggtgggccaattccaagtggactgctcgagcgcgggcagcgcggagctgaccattgagatctgctcggaggcggggcttccggccgaggtgtacatccaggaccacggtgatggcacgcacaccattacctacattcccctctgccccggggcctacaccgtcaccatcaagtacggcggccagcccgtgcccaacttccccagcaagctgcaggtggaacctgcggtggacacttccggtgtccagtgctatgggcctggtattgagggccagggtgtcttccgtgaggccaccactgagttcagtgtggacgcccgggctctgacacagaccggagggccgcacgtcaaggcccgtgtggccaacccctcaggcaacctgacggagacctacgttcaggaccgtggcgatggcatgtacaaagtggagtacacgccttacgaggagggactgcactccgtggacgtgacctatgacggcagtcccgtgcccagcagccccttccaggtgcccgtgaccgagggctgcgacccctcccgggtgcgtgtccacgggccaggcatccaaagtggcaccaccaacaagcccaacaagttcactgtggagaccaggggagctggcacgggcggcctgggcctggctgtagagggcccctccgaggccaagatgtcctgcatggataacaaggacggcagctgctcggtcgagtacatcccttatgaggctggcacctacagcctcaacgtcacctatggtggccatcaagtgccaggcagtcctttcaaggtccctgtgcatgatgtgacagatgcgtccaaggtcaagtgctctgggcccggcctgagcccaggcatggttcgtgccaacctccctcagtccttccaggtggacacaagcaaggctggtgtggccccattgcaggtcaaagtgcaagggcccaaaggcctggtggagccagtggacgtggtagacaacgctgatggcacccagaccgtcaattatgtgcccagccgagaagggccctacagcatctcagtactgtatggagatgaagaggtaccccggagccccttcaaggtcaaggtgctgcctactcatgatgccagcaaggtgaaggccagtggccccgggctcaacaccactggcgtgcctgccagcctgcccgtggagttcaccatcgatgcaaaggacgccggggagggcctgctggctgtccagatcacggatcccgaaggcaagccgaagaagacacacatccaagacaaccatgacggcacgtatacagtggcctacgtgccagacgtgacaggtcgctacaccatcctcatcaagtacggtggtgacgagatccccttctccccgtaccgcgtgcgtgccgtgcccaccggggacgccagcaagtgcactgtcacagtgtcaatcggaggtcacgggctaggtgctggcatcggccccaccattcagattggggaggagacggtgatcactgtggacactaaggcggcaggcaaaggcaaagtgacgtgcaccgtgtgcacgcctgatggctcagaggtggatgtggacgtggtggagaatgaggacggcactttcgacatcttctacacggccccccagccgggcaaatacgtcatctgtgtgcgctttggtggcgagcacgtgcccaacagccccttccaagtgacggctctggctggggaccagccctcggtgcagccccctctacggtctcagcagctggccccacagtacacctacgcccagggcggccagcagacttgggccccggagaggcccctggtgggtgtcaatgggctggatgtgaccagcctgaggccctttgaccttgtcatccccttcaccatcaagaagggcgagatcacaggggaggttcggatgccctcaggcaaggtggcgcagcccaccatcactgacaacaaagacggcaccgtgaccgtgcggtatgcacccagcgaggctggcctgcacgagatggacatccgctatgacaacatgcacatcccaggaagccccttgcagttctatgtggattacgtcaactgtggccatgtcactgcctatgggcctggcctcacccatggagtagtgaacaagcctgccaccttcaccgtcaacaccaaggatgcaggagaggggggcctgtctctggccattgagggcccgtccaaagcagaaatcagctgcactgacaaccaggatgggacatgcagcgtgtcctacctgcctgtgctgccgggggactacagcattctagtcaagtacaatgaacagcacgtcccaggcagccccttcactgctcgggtcacaggtgacgactccatgcgtatgtcccacctaaaggtcggctctgctgccgacatccccatcaacatctcagagacggatctcagcctgctgacggccactgtggtcccgccctcgggccgggaggagccctgtttgctgaagcggctgcgtaatggccacgtggggatttcattcgtgcccaaggagacgggggagcacctggtgcatgtgaagaaaaatggccagcacgtggccagcagccccatcccggtggtgatcagccagtcggaaattggggatgccagtcgtgttcgggtctctggtcagggccttcacgaaggccacacctttgagcctgcagagtttatcattgatacccgcgatgcaggctatggtgggctcagcctgtccattgagggccccagcaaggtggacatcaacacagaggacctggaggacgggacgtgcagggtcacctactgccccacagagccaggcaactacatcatcaacatcaagtttgccgaccagcacgtgcctggcagccccttctctgtgaaggtgacaggcgagggccgggtgaaagagagcatcacccgcaggcgtcgggctccttcagtggccaacgttggtagtcattgtgacctcagcctgaaaatccctgaaattagcatccaggatatgacagcccaggtgaccagcccatcgggcaagacccatgaggccgagatcgtggaaggggagaaccacacctactgcatccgctttgttcccgctgagatgggcacacacacagtcagcgtgaagtacaagggccagcacgtgcctgggagccccttccagttcaccgtggggcccctaggggaagggggagcccacaaggtccgagctgggggccctggcctggagagagctgaagctggagtgccagccgaattcagtatctggacccgggaagctggtgctggaggcctggccattgctgtcgagggccccagcaaggctgagatctcttttgaggaccgcaaggacggctcctgtggtgtggcttatgtggtccaggagccaggtgactacgaagtctcagtcaagttcaacgaggaacacattcccgacagccccttcgtggtgcctgtggcttctccgtctggcgacgcccgccgcctcactgtttctagccttcaggtgaggcaccgagagaaaccgcccacctggggctcctgggcccggacagaccagagccaccgcagagaccaggccttggccctgtgttcagtgacccccctggcccagctctgggttccaggcctctgctctggccgggtgcagcccacgcttggggtcggcaggaaatatcctgcccaccacgtggagtttttctcgtgtctcaggtctaaaggctttgaacagaagcctgtgccccttgagcaccagggctgcggtttaaagagggacagcctgccaaggctgggtgctgcccacagggtggggcagccctcccttcctgccacctgggtgtgtgcgacggcagagtgtgggggcaggggcggggatgtgcgcctgtggcttgctgccccttgcaaatcagtggctctccctctttaaaccaagttggacgccagatgggtaagtgcgacccgcgggcctcttgctcctggggcctttccgtcctcccttgccctggctcaagcacccccatctaaccatgtctgctgtgcttccaggagtcagggctaaaggtcaaccagccagcctcttttgcagtcagcctgaacggggccaagggggcgatcgatgccaaggtgcacagcccctcaggagccctggaggagtgctatgtcacagaaattgaccaaggtgaggccctgtccctgcccggccgccctgccctgctggctggaagcaggctgagagtacaaaaggaaggtaccgcttctgtaagcagccaagacggggccccaactcctgggccccctaagccaggcaaccctttcccaattggtgacccaagccgctggggatgtggctcgccacccacagctattaggaaggccttctaccctgcagtaccatgccatctccacagggaaagactcaaagtccagcctcagtgctgcccggcccttcagccacggccatggtacttgtgcacaggcctggggcagccttgtgggtaggaggagcccagtgggcttcatttcacggcctagtcctgcccttcccagctgcatgacctgaagcaagttcctgcccgtctctgagcctgttaacatgcaggggatatggtgttcacggtaacctttcttaggaggcagcaaggcctgggtttggcttgtaaaagatttccgtcccaatgcaccctgacggtgggcagcttgagtgtctaaaccttcggccctcaggaggtctgctgcggggtgcaggtgcccagcgtggctgggctcacactgatggaccggcaaaatggggagggccagggttgaggctgttcctcacagacaccatctgctggtttgaggaggggccccaggcccacagcatgactccctgctcctcagataagtatgctgtgcgcttcatccctcgggagaatggcgtttacctgattgacgtcaagttcaacggcacccacatccctggaagccccttcaagatccgagttggggagcctgggcatggaggggacccaggcttggtgtctgcttacggagcaggtctggaaggcggtgtcacagggaacccagctgagttcgtcgtgaacacgagcaatgcgggagctggtgccctgtcggtgaccattgacggcccctccaaggtgaagatggattgccaggagtgccctgagggctaccgcgtcacctatacccccatggcacctggcagctacctcatctccatcaagtacggcggcccctaccacattgggggcagccccttcaaggccaaagtcacaggcccccgtctcgtcagcaaccacagcctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagcaggcaacaacatgctgctggtgggggttcatggcccaaggaccccctgcgaggagatcctggtgaagcacgtgggcagccggctctacagcgtgtcctacctgcgctcacctgcctccccagccagccgctgacctctcggctttcacttgggcagagggagccatttggtggcgctgcttgtcttctttggttctgggaggggtgagggatgggggtcctgtacacaaccacccactagttctcttctccagccaagaggaataaagttttgcttccattc

SEQ ID NO: 741 - DNA, 1089 bp, Homo sapiens
atgcgggtcacggcgccccgaaccgtcctcctgctgctctcgggagccctggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagaagtacaagcgccaggcacagactgaccgagtgagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttga

SEQ ID NO: 742 - DNA, 3714 bp, Homo sapiens
  misc_feature (1)...(3714): n = A,T,C or G
aatctgcgtcgggtccttcttcctgaatgactcatgacgcgtccccaattcccactcccattgggtgtcggaccnntctagaaggccggtcagcgtctccgcagtcccggttctgaagtccccagtcacccacccggactcagattctccccagacgccgagatgcgggtcatggcgccccggaccctcatcctgctgctctcgggagccctggccctgaccgagacctgggccggtgagtgcggggttgggagggaatcggcctcttgcggagaggagcgaggggcccgcccggcggagggcgcaggacccggggagccgcgcagggaggagggtcgggcgggtctcagcccctcctcgccccaggctcccactccatgaggtatttctgcaccgctgtgtcccggcccggacgcggggagccccacttcatcgccgtgggctacgtggacgacacgcagttcgtgcggttcgacagcgacgacgagagtccgagaggggagccgagggcgccgtgggtggagcggaaggggccggagtattgggaccgggagacacagaagtacaagccccaggcacagactgaccgagtgagcctgcggaacctgcgcggctactacaaccagagcgaggccggtgagtggaccccggcccggggcgcaggtcacgacccctcctcatcccccacggacggcccgggtcgccccaagtctcccggtctgagatccaccccgaggctgcggaacccgagaccctcgaccggagagagccccagtcacctttacccggtttcattttcagtttaggccaaaatccccgcgggttggtcggggcggggcggggctcgggggacggggctgaccgcgggggcgggccagggtctcacatcatccagaggatgtatggctgcgacgtggggcccgacgggcgcctcctccgcgggtatgaccagcacgcctacgacggcaaggattacatcgccctgaacgaggatctgcgctcctggaccgccgcgaacacggcggctcagatcacccagcgcaagtgggaggcggcccgtgaggcggagcagctgagagcctacttggagggcctgtgcgtggagtggctccgcagatacctgaagaatgggaaggagacgctgcagggcgcgggtaccaggggcagtgggagcgttccccatctcctgtagatctcccgggatggcctcccacgaggaggggaggaaaatgggatcagcgctagaatatcgccctcccttgaatggagaatgggatgagttttcctgagtttcctctgagggccccctctgctctctgaggacaattaagggatgaagtccttgaagaaatggaggggaagacagtccctagaatactcatcaggggtcccctttgaccactttgaccactgcagcagctgtggtcaggctgctgacctttctctcaggccttgttctctgcctcacgctcaatgtgtttgaaggtttgattccagcttttctgagtccttcggcctccactcaggtcaggaccagaagtcgctgttcctccctcagagactagaactttccaatgaataggagattatcccaggtgcctgtgtccaggctggcgtctgggttctgtgcccccttccccaccccaggtgtcctgtccgttctcaggatggtcacatgggcgctgttggagtgtcgcaagagagatacaaagtgtctgaattttctgactcttcccgtcagaacacccaaagacacacgtgacccaccatcccgtctctgaccatgaggccaccctgaggtgctgggccctgggcttctaccctgcggagatcacactgacctggcagtgggatggggaggaccaaactcaggacactgagcttgtggagaccaggccagcaggagatggaaccttccagaagtgggcagctgtggtggtgccttctggagaagagcagagatacacgtgccatgtgcagcacgaggggctgccggagcccctcaccctgagatggggtaaggagggggatgaggggtgatgtgtcttctcagggaaagcagaagtcctggagcccttcagccaggtcagggctgaggcttgggggtcagggcccctcaccttcccctcctttcccagagccgtcttcccagcccaccatccccatcgtgggcatcgttgctggcctggctgtcctggctgtcctagctgtcctaggagctgtggtggctgttgtgatgtgtaggaggaagagctcaggtagggaaggggtgaggagtggggtctgggttttcttgttccactgggagtttcaagccccaggtagaagtgtgccccacctcgttactggaagcaccatccacacatgggccccatcccagcctgggaccctatgtgccagcacttactctgttgtgaagcacatgacaatgaaggacagatgtatcaccttgatgattatggtgttggggtccttgattccagcattcatgagtcaggggaaggtccctgctaaggacagaccttaggagggcagttgctccaacaaccacagctgctttccccgtgtttcctgatcctgccctgggtctgcagtcatagttctggaaacttctcttgggtccaagactaggaggttcccctaagatcgcatggccctgactcctccctgtcccctcacagggcattttcttcccacaggtggaaaaggagggagctgctctcaggctgcgtgtaagtgatggcggtgggcgtgtggaggagctgctctcaggctgcgtgtaagtgatggcggtgggcgtgtggaggagctcacccaccccataattcctcttgtcccacatctcctgcgggctctgaccaggtctttttttttgttctaccccagccagcaacagtgcccagggctctgatgagtctctcatcgcttgtaaaggtgagattctggggagctgaagtggtcgggggtggggcagagggaaaaggcctaggtaatggggatcctttgattgggacgtttcgaatgtgtggtgagctgttcagagtgtgatcacttaccatgactgacctgaatttgttcatgactattgtgttctgtagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccaccccctgtccaccgtgacccctgtccccacactgacctgtgttccctccccgatcatctttcctgttccagagaagtgggctggatgtctccatctctgtctcaacttcatggtgcgctgagctgcaacttcttacttccctaatgaagttaggaacctgaatataaatttgttttctcaaatatttgctatgaagggttgatggattaattaaataagtcaattcctggaagttgagagagcaaataaagacctgagaagctttccagaatccgcatgttctctgtggctgagtctgttgcaggtgggggtggggaaggctgtgaggagccgagtgtggacgggggcctgtgcctagttgctgttcagttcttcatgggctttatgtagtcagtccttagctgggtcaccttcactgctccattgtccttgtcccttcagtggaaacttgtccagcaggagc

SEQ ID NO: 743 - DNA, 1561 bp, Homo sapiens
agttctaaagtccccacgcacccacccggactcagaatctcctcagacgccgagatgcgggtcacggcgccccgaaccctcctcctgctgctctggggggcagtggccctgaccgagacctgggccggctcccactccatgaggtatttctacaccgccatgtcccggcccggccgcggggagccccgcttcatcaccgtgggctacgtggacgacacccagttcgtgaggttcgacagcgacgccacgagtccgaggatggcgccccgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtggaaaaggagggagctactctcaggctgcgtgcagcgacagtgcccagggctctgatgtgtctctcacagcttgaaaagcctgagacagctgtcttgtgagggactgagatgcaggatttcttcacgcctcccctttgtgacttcaagagcctctggcatctctttctgcaaaggcacctgaatgtgtctgcgtccctgttagcataatgtgaggaggtggagagacagcccacccttgtgtccactgtgacccctgttcccatgctgacctgtgtttcctccccagtcatctttcttgttccagagaggtggggctggatgtctccatctctgtctcaactttatgtgcactgagctgcaacttcttacttccctactgaaaataagaatctgaatataaatttgttttctcaaatatttgctatgagaggttgatggattaattaaataagtcaattcctggaatttgagagagcaaataaagacctgaga

SEQ ID NO: 744 - DNA, 1089 bp, Homo sapiens
atgcgggtcacggcaccccgaaccgtcctcctgctgctctggggggcagtggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggacggggagacacggaacatgaaggcctccgcgcagacttaccgagagaacctgcggatcgcgctccgctactacaaccagagcgaggccgggtctcacatcatccaggtgatgtatggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccaaagcccctcaccctgagatgggagccatcttcccaatccaccgtccccatcgtgggcattgttgctggcctggctgtcctagcagttgtggtcatcggagctgtggtcgctgctgtgatgtgtaggaggaagagctcaggtggaaaaggagggagctactctcaggctgcgtgcagcgacagtgcccagggctctgatgtgtctctcacagcttga

SEQ ID NO: 745 - DNA, 1093 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagacacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttgaaaag

SEQ ID NO: 746 - DNA, 1157 bp, Homo sapiens
agttctaaagtccccacgcacccacccggactcagaatctcctcagacgccgagatgcgggtcacggcgccccgaaccctcctcctgctgctctggggggcagtggccctgaccgagacctgggccggctcccactccatgaggtatttctacaccgccatgtcccggcccggccgcggggagccccgcttcatcaccgtgggctacgtggacgacacccagttcgtgaggttcgacagcgacgccacgagtccgaggatggcgccccgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtggaaaaggagggagctactctcaggctgcgtgcagcgacagtgcccagggctctgatgtgtctctcacagcttgaaaaggtgagattct

SEQ ID NO: 747 - DNA, 1089 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacatcatccagaggatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagacacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttga

SEQ ID NO: 748 - DNA, 1413 bp, Homo sapiens
tgctcccactccatgaggtatttcgacaccgccgtgtcccggcccggcgccggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacaggctgaccgagtgagcctgcggaacctgcgcggctactacaaccagagcgaggacgggtctcacaccctccagaggatgtctggctgcgacctggggcccgacgggcgcctcctccgcgggtatgaccagtccgcctacgacggcaaggattacatcgccctgaacgaggacctgcgctcctggaccgcggcggacaccgcggctcagatcacccagcgcaagtgggaggcggcccgtgcggcggagcagctgagagcctacctggagggactgtgcgtggagtggctccgcagatacctggagaacgggaaggagacgctgcagcgcgcagaacccccaaagacacacgtgacccaccaccccctctctgaccatgaggccaccctgaggtgctgggccctgggcttctaccctgcggagatcacactgacctggcagcgggatggggaggaccagacccaggacaccgagcttgtggagaccaggccagcaggagatggaaccttccagaagtgggcagctgtggtggtgccttctggacaagagcagagatacacgtgccatatgcagcacgaggggctgcaagagcccctcaccctgagctgggagccatcttcccagcccaccatccccatcatgggcatcgttgctggcctggctgtcctggttgtcctagctgtccttggagctgtggtcaccgctatgatgtgtaggaggaagagctcaggtggaaaaggagggagctgctctcaggctgcgtgcagcaacagtgcccagggctctgatgagtctctcatcacttgtaaagcctgagacagctgcctgtgtgggactgagatgcaggatttcttcacacctctcctttgtgacttcaagagcctctggcatctctttctgcaaaggcacctgaatgtgtctgcgttcctgttagcataatgtgaggaggtggagagacagcccacccccgtgtccaccgtgacccctgtccccacactgacctgtgttccctccccgatcatctttcctgttccagagaggtggggctggatgtctccatctctgtctcaaattcatggtgcactgagctgcaacttcttacttccctaatgaagttaagaacctgaatataaatttgtgttctcaaatatttgctatgaagcgttgatggattaattaaataagtcaattcctaaaaac

SEQ ID NO: 749 - DNA, 1089 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagcggagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttga

SEQ ID NO: 750 - DNA, 1089 bp, Homo sapiens
atgcgggtcacggcaccccgaaccctcctcctgctgctctggggggccctggccctgaccgagacctgggccggctcccactccatgaggtatttctacaccgccatgtcccggcccggccgcggggagccccgcttcatcgcagtgggctacgtggacgacacgcagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacacttggcagacgatgtatggctgcgacctggggccggacgggcgcctcctccgcgggcataaccagttagcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttga

SEQ ID NO: 751 - DNA, 3950 bp, Homo sapiens
aatcattcagggattaccaatattgtgctacctactgtatcaataaacaaaaaggaaactggtctctatgagaatctctgtgtggtggcttcagacaaaacttcgccaggtttagagagaaaacccctgtctctacacctccattcccagggcgagctcactctctggcatcaagttctccgtgatcagtttccctacacaagatccaagaggagaggtaaggagtgagaggcagggagtccagttcagggacagggattccaggaggagaagtgaaggggaagcgggtcgggcagcctgggggtctctccctggtttccacagacagatccttgtgcaggactcaggcagacagtgtgacaaagaggctggtgtaggagaagagggatcaggacgaagtcccagccgcgggcggggctctcagggtctcaggctccgagagccttgtctgcattggggaggcgcagcgttggggattccccactcccacgagtttcacttcttctcccaacctatgtcgggtccttcttccaggatactcgtgacgcgtccccatttcccactccattgggtgtcggatatctagagaagccaatcagtgtcgccggggtcccagttctaaagtccccacgcacccacccggactcagaatctcctcagacgccgagatgcgggtcacggcgccccgaaccgtcctcctgctgctctggggggcagtggccctgaccgagacctgggccggtgagtgcggggtcgggagggaaatggcctctgtggggaggagcgaggggaccgcaggcgggggcgcaggacctgaggagccgcgccgggaggagggtcgggcgggtctcagcccctcctcgcccccaggctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccggtgagtgaccccggcccggggcgcaggtcacgactccccatcccccacgtacggcccggggtcgccccgagtctccgggtccgagatccgcctccctgaggccgcgggacccgcccagaccctcgaccggcgagagccccaggcgcgtttacccggtttcattttcagttgaggccaaaatccccgcgggttggtcggggcggggcggggctcgggggacggggctgaccgcggggccggggccagggtctcacatcatccagaggatgtatggctgcgacctggggcccgacgggcgcttcctccgcgggcataaccagtacgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcgggtaccaggggcagtggggagccttccccatctcctataggtcgccggggatggcctcccacgagaagaggaggaaaatgggatcagcgctagaatgtcgccctcccttgaatggagaatggcatgagttttcctgagtttcctctgagggccccctcttctctctaggacaattaagggatgacgtctctgaggaaatggaggggaagacagtccctagaatactgatcaggggtcccctttgacccctgcagcagccttgggaaccgtgacttttcctctcaggccttgttctctgcctcacactcagtgtgtttggggctctgattccagcacttctgagtcactttacctccactcagatcaggagcagaagtccctgttccccgctcagagactcgaactttccaatgaataggagattatcccaggtgcctgcgtccaggctggtgtctgggttctgtgccccttccccacaccaggtgtcctgtccattctcaggctggtcacatgggtggtcctagggtgtcccatgagagatgcaaagcgcctgaattttctgactcttcccatcagaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatggggtaaggagggggatgaggggtcatatctcttctcagggaaagcaggagcccttctggagcccttcagcagggtcagggcccctcgtcttcccctcctttcccagagccatcttcccagtccaccatccccatcgtgggcattgttgctggcctggctgtcctagcagttgtggtcatcggagctgtggtcgctactgtgatgtgtaggaggaagagctcaggtagggaaggggtgaggggtggggtctgggttttcttgtcccactgggggtttcaagccccaggtagaagtgttccctgcctcattactgggaagcagcatccacacaggggctaacgcagcctgggaccctgtgtgccagcacttactcttttgtgcagcacatgtgacaatgaaggacggatgtatcaccttgatggttgtggtgttggggtcctgatttcagcattcatgagtcaggggaaggtccctgctaaggacagaccttaggagggcagttggtccaggacccacacttgctttcctcgtgtttcctgatcctgccttgggtctgtagtcatacttctggaaattccttttgggtccaagacgaggaggttcctctaagatcttaaggccctgcttcctcccagtcccctcacaggacattttcttcccacaggtggaaaaggagggagctactctcaggctgcgtgtaagtggtgggggtgggagtgtggaggagctcacccaccccataattcctcctgtcccacgtctcctgcgggctctgaccaggtcctgtttttgttctactccagccagcgacagtgcccagggctctgatgtgtctctcacagcttgaaaaggtgagattcttggggtctagagtgggcggggggggcggggagggggcagaggggaaaggcctgggtaatggagattctttgattgggatgtttcgcgtgtgtcgtgggctgttcagagtgtcatcacttaccatgactaaccagaatttgttcatgactgttgttttctgtagcctgagacagctgtcttgtgagggactgagatgcaggatttcttcactcctcccctttgtgacttcaagagcctctggcatctctttctgcaaacggcacctgaatgtgtctgcgtccctgttagcctaatgtgaggaggtggagagacagcccacccccgtgtccactgtgacccctgttcccatgctgacctgtgtttcctccccagtcatctttcttgttccagagaggtggggctggatgtctccatctctgtctcaactttatgtgcactgagctgcaacttcttacttccctactgaaaataagaatctgaatataaacttgttttctcaaatatttgctatgagaggttgatggattaattaaataagtcaattcctggaatttgagagagcaaataaagacctgaga

SEQ ID NO: 752 - DNA, 1089 bp, Homo sapiens
atgcgggtcacggcaccccgaaccctcctcctgctgctctggggggccctggccctgaccgagacctgggccggctcccactccatgaggtatttctacaccgccatgtcccggcccggccgcggggagccccgcttcatcgcagtgggctacgtggacgacacgcagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagaggatgtacggctgcgacctggggccggacgggcgcctcctccgcgggcataaccagttagcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttga

SEQ ID NO: 753 - DNA, 1089 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacatcatccagaggatgtatggctgcgacctggggcccgacgggcgcctcctccgcgggcatgaccagttcgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttga

SEQ ID NO: 754 - DNA, 1101 bp, Homo sapiens
atgcgggtcatggcgccccgaaccctcatcctgctgctctcgggagccctggccctgaccgagacctgggccggctcccactccatgaggtatttctacaccgctgtgtcccggcccggccgcggggagccccacttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacatcctccagaggatgtatggctgcgacgtggggcccgacgggcgcctcctccgcgggtatgaccagtccgcctacgacggcaaggattacatcgccctgaacgaggatctgcgctcctggaccgccgcggacacggcggctcagatcacccagcgcaagtgggaggcggcccgtgaggcggagcagctgagagcctacctggagggcctgtgcgtggagtggctccgcagatacctgaagaatgggaaggagacgctgcagcgcgcggaacacccaaagacacacgtgacccaccatcccgtctctgaccatgaggccaccctgaggtgctgggccctgggcttctaccctgcggagatcacactgacctggcagtgggatggggaggaccaaactcaggacactgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctggctgtcctagctgtcctaggagctgtggtggctgttgtgatgtgtaggaggaagagctcaggtggaaaaggagggagctgctctcaggctgcgtccagcaacagtgcccagggctctgatgagtctctcatcgcttgtaaagcctga

SEQ ID NO: 755 - DNA, 1093 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggacggggagacacggaacatgaaggcctccgcgcagacttaccgagagaacctgcggatcgcgctccgctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttgaaaag

SEQ ID NO: 756 - DNA, 1089 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagactgaccgagagagcctgcggaacctgcgcggctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagacacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttga

SEQ ID NO: 757 - DNA, 1089 bp, Homo sapiens
atgcgggtcacggcgccccgaaccgtcctcctgctgctctcgggagccctggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccggaacacacagatctccaagaccaacacacagacttaccgagagagcctgcggaacctgcgcggctactacaaccagagcgaggccgggtctcacatcatccagaggatgtatggctgcgacgtggggccggacgggcgcctcctccgcgggtatgaccagtccgcctacgacggcaaggattacatcgccctgaacgaggacctgagctcctggaccgcggcggacacggcggctcagatcacccagcgcaagtgggaggcggcccgtgaggcggagcagctgagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttga

SEQ ID NO: 758 - DNA, 1098 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacatcatccagaggatgtatggctgcgacctggggcccgacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttgaaagcctgag

SEQ ID NO: 759 - DNA, 1101 bp, Homo sapiens
atgcgggtcatggcgccccgaaccctcatcctgctgctctcgggagccctggccctgaccgagacctgggccggctcccactccatgaggtatttctacaccgctgtgtcccggcccggccgcggggagccccacttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacatcatccagaggatgtatggctgcgacgtggggcccgacgggcgcctcctccgcgggtatgaccagtacgcctacgacggcaaggattacatcgccctgaacgaggatctgcgctcctggaccgccgcggacacggcggctcagatcacccagcgcaagtgggaggcggcccgtgaggcggagcagctgagagcctacctggagggcctgtgcgtggagtggctccgcagatacctgaagaatgggaaggagacgctgcagcgcgcggaacacccaaagacacacgtgacccaccatcccgtctctgaccatgaggccaccctgaggtgctgggccctgggcttctaccctgcggagatcacactgacctggcagtgggatggggaggaccaaactcaggacactgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccgtcttcccagcccaccatccccatcgtgggcatcgttgctggcctggctgtcctggctgtcctagctgtcctaggagctgtggtggctgttgtgatgtgtaggaggaagagctcaggtggaaaaggagggagctgctctcaggctgcgtccagcaacagtgcccagggctctgatgagtctctcatcgcttgtaaagcctga

SEQ ID NO: 760 - DNA, 1089 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttga

SEQ ID NO: 761 - DNA, 1089 bp, Homo sapiens
atgcgggtcacggcgccccgaaccgtcctcctgctgctctcgggagccctggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttga

SEQ ID NO: 762 - DNA, 1089 bp, Homo sapiens
atgcgggtcacggcgccccgaaccgtcctcctgctgctctcgggagccctggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacacttggcagacgatgtatggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttga

SEQ ID NO: 763 - DNA, 1089 bp, Homo sapiens
atgcgggtcacggcgccccgaaccgtcctcctgctgctctggggggcagtggccctgaccgagacctgggccggctcccactccatgaggtatttctacaccgccatgtcccggcccgtccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttga

SEQ ID NO: 764 - DNA, 1098 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacaccctccagagcatgtacggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttgaaagcctgag

SEQ ID NO: 765 - DNA, 1583 bp, Homo sapiens
atgcaaatagatgggaaaatttattctataataagttttccagttagagattctgtttcaacattgggtgtgatagggattttaatatgctttgatgagtcgttagatattattgaaaatcagttgtattcttctcttaaatttggtagtaaaaattataatttttttatgcttgacagaaattacatgcccattttttcaaaccttaataatcttcaggccaaatctttttctacagcttatagtgagaattttttgagtaaagttatagcttatgctaaaaaagattcttctagctctcagtacacttttaattatgaaagagatttttattctttaaactttgtaaaaaccgatgattttttgactcaggggcttattttaaatgtcaattccattcctattatgtttaaatcaaattgggttatatttgttgcatttttattattgtcttttgcaattattttttatttatgcaatacttttgttttttcattaattaatgattttaacagaattgttgactatcaaaaatcaaaaagcgatccttttagtcttgaatctcccttagaggttaagtattcttcatctattatttcttatattagttcaaagctagataatctgtcttctaagagtaatgaatcttttgagaagataaaattttattctgaagatttgaatgaatatttggaacaaatagaaactgctatatcaaatactgagagtatagattctagcattttagtttacgaacaactaagagatactttttctagatttgaaaaatcaattgttgatattttaaaaggctttgaatctattgctgatccgattaatgatcacaataaatatatatcagaaatctcttcaaattttgaagagagtgttagttttttctatagtatagatatttaaatattgtttttgaaaatgtgaataaaaattttgcagatcttttgtctcaaacaaatagtttgcaaagtgtaaataaacttttagtttcaatttcagctcagaccaatatgcttgctatgaatgcagcaattgaagcagcaaaagcaggtgatgcaggtaaaagttttgcagttgttgctgaggagattagaaagcttgctattaattctggaaaatattctaaaaccattaaagatgaacttaaaacggtcgacagcattattgcagtaattaattcagagattgatacaatttataaaaatttcatagacattcaagataatgtggacaacaatttttcaagacacgagaaagtagatcttactcttgctaagcattttaaagaaattggcgagtttaaagaaaggtatttgtctcacgatactaagatcagagatgctaagaatatgtataaagaaatatttaataatcattattttattagtggcaagtttaacaactttagtcaagatttaaaagagtttaaagtttctaagatgaatttagatgcggtaagttctcttcaagaatattcatctttagtaaagtcttctaaggataagatattaaagacaaaggaattgattcaaaagattaatgatgagattaaagatattcttttttag

SEQ ID NO: 766 - DNA, 1089 bp, Homo sapiens
atgcgggtcacggcaccccgaaccgtcctcctgctgctctcggcggccctggccctgaccgagacctgggccggctcccactccatgaggtatttccacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcggatcgcgctccgctactacaaccagagcgaggccgggtctcacacttggcagaggatgtatggctgcgacctggggcccgacgggcgcctcctccgcgggtataaccagttagcctacgacggcaaggattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttga

SEQ ID NO: 767 - DNA, 1433 bp, Homo sapiens
tgtgtgtctgtgtctgtctgtgtctcgcagcggcgcgcggccccggacaagcgctggggattcccgtttgaggcgtcactactgtcactgccatcaccccacggagccacttctagaggggagtagacccggcccttcgccgggcagagaagatgttgcccctgtccatcaaagacgatgaatacaaaccacccaagttcaatttgttcggcaagatctcgggctggtttaggtctatactgtccgacaagacttcccggaacctgtttttcttcctgtgcctgaacctctctttcgcttttgtggaactactctacggcatctggagcaactgcttaggcttgatttccgactcttttcacatgtttttcgatagcactgccattttggctggactggcagcttctgttatttcaaaatggagagataatgatgctttctcctatgggtatgttagagcggaagttctggctggctttgtcaatggcctatttttgatcttcactgctttttttattttctcagaaggagttgagagagcattagcccctccagatgtccaccatgagagactgcttcttgtttccattcttgggtttgtggtaaacctaataggaatatttgttttcaaacatggaggtcatggacattctcatggctctggccacggacacagtcattccctctttaatggtgctctagatcaggcacatggccatgtcgatcattgccatagccatgaagtgaaacatggtgctgcacatagccatgatcatgctcatggacatggacactttcattctcatgatggcccgtccttaaaagaaacaacaggacccagcagacagattttacaaggtgtatttttacatatcctagcagatacacttggaagtattggtgtaattgcttctgccatcatgatgcaaaattttggtctgatgatagcagatcctatctgttcaattcttatagccattcttatagttgtaagtgttattcctcttttaagagaatctgttggaatattaatgcagagaactcctcccctattagaaaatagtctgcctcagtgctatcagagggtacagcagttgcaaggagtttacagtttacaggaacagcacttctggactttatgttctgacgtttatgttgggaccttgaaattaatagtagcacctgatgctgatgctaggtggattttaagccaaacacataatatttttactcaggctggagtgagacagctctacgtacagattgactttgcagccatgtagtgaatggaaagaaattatgcaccttttatggaccaaatttttctgccagtaagaatttcagttgtgggcctccagtcttctggaatgtcttcactgcagctgctggaaatcactgctttcattcccacaaaaccagtattactttttttt

SEQ ID NO: 768 - DNA, 1748 bp, Homo sapiens
tgtgtgtctgtgtctgtctgtgtctcgcagcggcgcgcggccccggacaagcgctggggattcccgtttgaggcgtcactactgtcactgccatcaccccacggagccacttctagaggggagtagacccggcccttcgccgggcagagaagatgttgcccctgtccatcaaagacgatgaatacaaaccacccaagttcaatttgttcggcaagatctcgggctggtttaggtctatactgtccgacaagacttcccggaacctgtttttcttcctgtgcctgaacctctctttcgcttttgtggaactactctacggcatctggagcaactgcttaggcttgatttccgactcttttcacatgtttttcgatagcactgccattttggctggactggcagcttctgttatttcaaaatggagagataatgatgctttctcctatgggtatgttagagcggaagttctggctggctttgtcaatggcctatttttgatcttcactgctttttttattttctcagaaggagttgagagagcattagcccctccagatgtccaccatgagagactgcttcttgtttccattcttgggtttgtggtaaacctaataggaatatttgttttcaaacatggaggtcatggacattctcatggctctggccacggacacagtcattccctctttaatggtgctctagatcaggcacatggccatgtcgatcattgccatagccatgaagtgaaacatggtgctgcacatagccatgatcatgctcatggacatggacactttcattctcatgatggcccgtccttaaaagaaacaacaggacccagcagacagattttacaaggtgtatttttacatatcctagcagatacacttggaagtattggtgtaattgcttctgccatcatgatgcaaaattttggtctgatgatagcagatcctatctgttcaattcttatagccattcttatagttgtaagtgttattcctcttttaagagaatctgttggaatattaatgcagagaactcctcccctattagaaaatagtctgcctcagtgctatcagagggtacagcagttgcaaggagtttacagtttacaggaacagcacttctggactttatgttctgacgtttatgttgggaccttgaaattaatagtagcacctgatgctgatgctaggtggattttaagccaaacacataatatttttactcaggctggagtgagacagctctacgtacagattgactttgcagccatgtagtgaatggaaagaaattatgcaccttttatggaccaaatttttctggtactgtacgatccaaaacattgtacccagctttttaaaagagagaaattatcactacaactcccgagcactaagtagacggggtagagtcagccgttcatgctttgtggggagttcacagctaagggatcagatttaagaggatatctcctggacttttggtcttttcttttgtgctctttcctccaaatctttttgacttctgaggtttttagcttaggatgttaatttgtccttttgtctttctttttttgtttttgttttctgtttgtttgttttcatgttgaatgcccacaccaccatcctctcatcccagccagtaagaatttcagttgtgggcctccagtcttctggaatgtcttcactgcagctgctggaaatcactgctttcattcccacaaaaccagtattacttttttt

SEQ ID NO: 769 - DNA, 4826 bp, Homo sapiens
ggcggcggcggcggcggcggcggcggggattgtttttgttgtcgctgaggccggaagagccggagccgggtccctgtccccgggccgggcgccgccgccgccccctgcccagcgcccgcgtctccgcggcgccaccccagcgccaatattccggagatcaagcgttacgcggcggcggcggcggcggcggcggggcccggagcgggaggcgccggggaccggggcgaggcggcccccgccgccgccatggaggcgctgggacccggacctccggctagcctgtttcagccacctcgtcgtcctggccttggaactgttggaaaaccaattcgactgttagccaatcattttcaggttcagattcctaaaatagatgtgtatcactatgatgtggatattaagcctgaaaaacggcctcgtagagtcaacagggaggtagtagatacaatggtgcggcacttcaagatgcaaatatttggtgatcggcagcctgggtatgatggcaaaagaaacatgtacacagcacatccactaccaattggacgggatagggttgatatggaggtgactcttccaggcgagggtaaagaccaaacatttaaagtgtctgttcagtgggtgtcagttgtgagccttcagttgcttttagaagctttggctgggcacttgaatgaagtcccagatgactcagtacaagcacttgatgttatcacaagacaccttccctccatgaggttagtaccttggtttggattatttcctacaaatgtcagacttttttggtacaccccagtgggccgttcctttttctcacccccggaaggttactaccaccctctgggagggggcagggaggtctggtttggttttcatcagtctgtgagacctgccatgtggaatatgatgctcaacattgatgtatctgcaactgctttctaccgggctcagcctatcattgagttcatgtgtgaggttttagacattcagaacatcaatgaacagaccaaacctctaacagactcccagcgtgtcaaatttaccaaagaaatcagaggtctcaaagttgaggtgacccactgtggacagatgaaacgaaaataccgagtttgtaatgtgactagacggccagccaacattctctcctatagttttcctttgcagctagaaaacggtcaagctatggaatgtacagtagctcaatattttaagcaaaagtatagtctgcaactgaaatacccccatcttccctgtctccaagtgggacaagaacaaaagcatacatacttgccactcgaggtctgtaatatagtggcaggacagcgatgtatcaagaagctcacagacaatcagacttccacaatgatcaaagctacagcaagatctgctcctgacagacaggaagagatcagtagactggtgaagagcaacagtatggtgggtggacctgatccataccttaaagaatttggtattgttgtccacaatgaaatgacagagctcacaggcagggtacttccagcaccaatgctgcaatatggaggccggaataaaacagtagccacacccaaccagggtgtctgggacatgcgaggaaagcagttttatgctggcattgaaattaaagtttgggcagttgcttgttttgcacctcagaaacaatgtagggaagatttactaaagagtttcactgaccagctgcgtaaaatctctaaggatgcaggaatgcccatccagggtcagccatgtttctgcaagtatgcacaaggtgcagacagtgtggagcctatgtttaaacatctgaaaatgacttatgtgggcctacagctaatagtggttatcctgcctggaaagacaccagtatatgcggaggtgaaacgtgttggagatacccttctaggtatggccacacagtgtgtccaggtaaaaaatgtagtgaagacctcacctcaaaccctttccaatctttgcctgaagataaatgcaaaacttggaggaattaacaatgtgcttgtgcctcatcaaaggccctcggtgttccagcagcctgtcatcttcctgggagcggatgtcacacaccccccagcaggggatgggaagaaaccttccattgctgctgtggttggcagtatggatggccaccccagccggtactgtgccaccgttcgggtgcagacttcccggcaggagatctcccaagagctcctctacagtcaagaggtcatccaggacctgactaacatggttcgagagctgctgattcagttctacaaatccacacgcttcaaacccactcggatcatctattaccgtggaggggtatctgagggacaaatgaaacaggtagcttggccagaactaatagcaattcgaaaggcatgtattagcttggaagaagattaccggccaggaataacttatattgtggtgcaaaaaagacatcacacacgactcttctgtgcagataaaacagaaagggtagggaaaagtggcaatgtaccagcaggcactacagtggatagtaccatcacacatccatctgagtttgacttttacctctgtagtcatgcaggaattcagggaaccagccgtccctcacattaccaggtcttgtgggatgacaactgcttcactgcagatgaactccagctactgacttaccagctgtgtcacacctatgtgaggtgcactcgctccgtctctattccagcccctgcatattatgcccggcttgtagcatttagggcaaggtatcatctggtggataaagatcatgacagtgcggaaggcagtcatgtgtcaggacagagcaacggccgggatcctcaggccttggctaaggctgtgcaaatccaccatgatacccagcacacgatgtattttgcctgagagtctcagaaaaagaactcaaccaatttggcaccccatgcagcctcaaaatgtttcaaatgcctaccgcctctagatcgagccacgttgacttcaggtggtcttctaccagcagctcggaatagttgcactgaatctatactttgcagcactgtctgatgcgtcaacaaaattgagccatttttttaaagtaatagatactaatagattatcttttctgatgcactggactgaatttttacctcaatgtgcaaaggctgatcagcctgaactttctaaaggactttacaagaagggtttctatggaatattttgctagctgtggtgttcaccgcatccctctagtcttagaagagaagattattccttttttctgtagtcattgagtggggtatatgcataagtgggagagaaaaaccaaacaatctacttcagttcagtgtaactatttaattgtgtgggtccatagactttttaatgaagatttctgactttgccactgtaaatgcctttaatgagcattaatttttgaaagttttacagagttttattagttttactactttatcttattgatctctgcagacttgtgctggtgcaagtacatgctgacaggcaatttgcactatatttggctgcagattcaaataggcagttctcttatttggtcgacttttgtgaatgtgtgacataaacagatgtaatgcatgtcacagtgacggagataacactgccatgataaaagtactcatgtttcccctatttggaaaaaaaaattgcttttagtatttttccaagttttcaaaagtgcccattttatgctgctgtgtggtttgttaaatctaaatgatttttaaacttttctcatagaaacttaactttggcaataaacattttttaaggtctctcctcttccttccccaacaatgtagttttctagatgagatttcagtatgattttatcagctatttcttatatatcataatctggcaatttctgaaaccagtcagaaaagacatatatttccatgcctttttaaagaattatttttacctgttttatattcacagttggtgtcctgtcactttgttttaaaataagctagaaccaggatgcttccttattggaaaggctttgccagtccttaaggtacaatgagtgatgctgcaacttgcaaatgtaccagcatttaaaatttcttttcctgggaatcaaggtaactcacacgactacttgcagtacaaattttttgcttctctttcgacatgaaatgtacttggtgggttttccttccttttattaaactaaaactgtgtggaaaaggttgatttttcttaatagattctggattccactcacagggagatgggattcctttcttgtccaaacaaagggagttgctctaaagcgagcatcagttaaaatgtaggggaaaatgtattctgtatgtagtgtagataatactttgtgaatggacaacagttacatagtgtcttggtagcaccagccagtgtttcccagcccagagtttactgacttgtaattctctatccaggacatcaggagtgagggatggaaaaggggataaaaggcctggagccacactctatatggctgaggaaggagctagggaaagagatagacacaatggggtgaaaacaattttgccgcccctgcctggaaactgctggtggggaaatgatggtgaagggtgtttgcttgaactcatgagacggtccaaatctcataaactagccttctcaaaatcccagcaatataaagcactgtttttcttcagtcgtttaaataaacttgtaaatacattgaagtttacatttccatgtgctgttgatcaacggcgccacctgtgtttgctgagactggtctctgagagagttttatgtcgatcgaggcctgttgctcattaagctgagtgcag

SEQ ID NO: 770 - DNA, 3016 bp, Homo sapiens
ggcggcggcggcggcggcggcggcggggattgtttttgttgtcgctgaggccggaagagccggagccgggtccctgtccccgggccgggcgccgccgccgccccctgcccagcgcccgcgtctccgcggcgccaccccagcgccaatattccggagatcaagcgttacgcggcggcggcggcggcggcggcggggcccggagcgggaggcgccggggaccggggcgaggcggcccccgccgccgccatggaggcgctgggacccggacctccggctagcctgtttcagccacctcgtcgtcctggccttggaactgttggaaaaccaattcgactgttagccaatcattttcaggttcagattcctaaaatagatgtgtatcactatgatgtggatattaagcctgaaaaacggcctcgtagagtcaacagggaggtagtagatacaatggtgcggcacttcaagatgcaaatatttggtgatcggcagcctgggtatgatggcaaaagaaacatgtacacagcacatccactaccaattggacgggatagggttgatatggaggtgactcttccaggcgagggtaaagaccaaacatttaaagtgtctgttcagtgggtgtcagttgtgagccttcagttgcttttagaagctttggctgggcacttgaatgaagtcccagatgactcagtacaagcacttgatgttatcacaagacaccttccctccatgaggtacaccccagtgggccgttcctttttctcacccccggaaggttactaccaccctctgggagggggcagggaggtctggtttggttttcatcagtctgtgagacctgccatgtggaatatgatgctcaacattgatgtatctgcaactgctttctaccgggctcagcctatcattgagttcatgtgtgaggttttagacattcagaacatcaatgaacagaccaaacctctaacagactcccagcgtgtcaaatttaccaaagaaatcagaggtctcaaagttgaggtgacccactgtggacagatgaaacgaaaataccgagtttgtaatgtgactagacggccagccagtcatcaaacttttcctttgcagctagaaaacggtcaagctatggaatgtacagtagctcaatattttaagcaaaagtatagtctgcaactgaaatacccccatcttccctgtctccaagtgggacaagaacaaaagcatacatacttgccactcgaggtctgtaatatagtggcaggacagcgatgtatcaagaagctcacagacaatcagacttccacaatgatcaaagctacagcaagatctgctcctgacagacaggaagagatcagtagactggtgaagagcaacagtatggtgggtggacctgatccataccttaaagaatttggtattgttgtccacaatgaaatgacagagctcacaggcagggtacttccagcaccaatgctgcaatatggaggccggaataaaacagtagccacacccaaccagggtgtctgggacatgcgaggaaagcagttttatgctggcattgaaattaaagtttgggcagttgcttgttttgcacctcagaaacaatgtagggaagatttactaaagagtttcactgaccagctgcgtaaaatctctaaggatgcaggaatgcccatccagggtcagccatgtttctgcaagtatgcacaaggtgcagacagtgtggagcctatgtttaaacatctgaaaatgacttatgtgggcctacagctaatagtggttatcctgcctggaaagacaccagtatatgcggaggtgaaacgtgttggagatacccttctaggtatggccacacagtgtgtccaggtaaaaaatgtagtgaagacctcacctcaaaccctttccaatctttgcctgaagataaatgcaaaacttggaggaattaacaatgtgcttgtgcctcatcaaaggccctcggtgttccagcagcctgtcatcttcctgggagcggatgtcacacaccccccagcaggggatgggaagaaaccttccattgctgctgtggttggcagtatggatggccaccccagccggtactgtgccaccgttcgggtgcagacttcccggcaggagatctcccaagagctcctctacagtcaagaggtcatccaggacctgactaacatggttcgagagctgctgattcagttctacaaatccacacgcttcaaacccactcggatcatctattaccgtggaggggtatctgagggacaaatgaaacaggtagcttggccagaactaatagcaattcgaaaggcatgtattagcttggaagaagattaccggccaggaataacttatattgtggtgcaaaaaagacatcacacacgactcttctgtgcagataaaacagaaagggtagggaaaagtggcaatgtaccagcaggcactacagtggatagtaccatcacacatccatctgagtttgacttttacctctgtagtcatgcaggaattcagggaaccagccgtccctcacattaccaggtcttgtgggatgacaactgcttcactgcagatgaactccagctactgacttaccagctgtgtcacacctatgtgaggtgcactcgctccgtctctattccagcccctgcatattatgcccggcttgtagcatttagggcaaggtatcatctggtggataaagatcatgacagtgcggaaggcagtcatgtgtcaggacagagcaacggccgggatcctcaggccttggctaaggctgtgcaaatccaccatgatacccagcacacgatgtattttgcctgagagtctcagaaaaagaactcaaccaatttggcaccccatgcagcctcaaaatgtttcaaatgcctaccgcctctagatcgagccacgttgacttcagttggtgtcctgtcactttgttttaaaataagctagaaccaggatgcttccttattggaaaggctttgccagtccttaaggtacaatg

SEQ ID NO: 771 - DNA, 3050 bp, Homo sapiens
tgagtgcccgtcgcgtcgcgccgcgtcgccccccgggccgcctccttgccgccagtggcgggctccgttctccctcgaagcactccccccagctccatgaatggaaatcggctccgcaggacccgctggggcccagcccctactcatggtgcccagaagacctggctatggcgccatgggcaaacccattaaactgctggctaactgttttcaagttgaaatcccaaagattgatgtctacctctatgaggtagatattaaaccagacaagtgtcctaggagagtgaacagggaggtggttgactcaatggttcagcattttaaagtaactatatttggagaccgtagaccagtttatgatggaaaaagaagtctttacaccgccaatccacttcctgtggcaactacaggggtagatttagacgttactttacctggggaaggtggaaaagatcgacctttcaaggtgtcaatcaaatttgtctctcgggtgagttggcacctactgcatgaagtactgacaggacggactttgcctgagccactggaattagacaagccaatcagcactaaccctgtccatgccgttgatgtggtgctacgacatctgccctccatgaaatacacacctgtggggcgttcatttttctccgctccagaaggatatgaccaccctctgggagggggcagggaagtgtggtttggattccatcagtctgttcggcctgccatgtggaaaatgatgcttaatatcgatgtttctgccactgccttctacaaagcacaacctgtaattcagttcatgtgtgaagttcttgatattcataatattgatgagcaaccaagacctctgactgattctcatcgggtaaaattcaccaaagagataaaaggtttgaaggttgaagtgactcattgtggaacaatgagacggaaataccgtgtttgtaatgtaacaaggaggcctgccagtcatcaaacctttcctttacagttagaaaacggccaaactgtggagagaacagtagcgcagtatttcagagaaaagtatactcttcagctgaagtacccgcaccttccctgtctgcaagtcgggcaggaacagaaacacacctacctgccactagaagtctgtaatattgtggcagggcaacgatgtatcaagaagctaacagacaatcagacttccactatgatcaaggcaacagcaagatctgcaccagatagacaagaggaaattagcagattggtaagaagtgcaaattatgaaacagatccatttgttcaggagtttcaatttaaagttcgggatgaaatggctcatgtaactggacgcgtacttccagcacctatgctccagtatggaggacggaatcggacagtagcaacaccgagccatggagtatgggacatgcgagggaaacaattccacacaggagttgaaatcaaaatgtgggctatcgcttgttttgccacacagaggcagtgcagagaagaaatattgaagggtttcacagaccagctgcgtaagatttctaaggatgcagggatgcccatccagggccagccatgcttctgcaaatatgcacagggggcagacagcgtagagcccatgttccggcatctcaagaacacatattctggcctacagcttattatcgtcatcctgccggggaagacaccagtgtatgcggaagtgaaacgtgtaggagacacacttttgggtatggctacacaatgtgttcaagtcaagaatgtaataaaaacatctcctcaaactctgtcaaacttgtgcctaaagataaatgttaaactcggagggatcaataatattcttgtacctcatcaaagaccttctgtgttccagcaaccagtgatctttttgggagccgatgtcactcatccacctgctggtgatggaaagaagccttctattgctgctgttgtaggtagtatggatgcacacccaagcagatactgtgccacagtaagagttcagagaccccgacaggagatcatccaggacttggcctccatggtccgggaacttcttattcaattttataagtcaactcggttcaagcctactcgtatcatcttttatcgggatggtgtttcagaggggcagtttaggcaggtattatattatgaactactagcaattcgagaagcctgcatcagtttggagaaagactatcaacctggaataacctacattgtagttcagaagagacatcacactcgattattttgtgctgataggacagaaagggttggaagaagtggcaatatcccagctggaacaacagttgatacagacattacacacccatatgagttcgatttttacctctgtagccatgctggaatacagggtaccagtcgtccttcacactatcatgttttatgggatgataactgctttactgcagatgaacttcagctgctaacttaccagctctgccacacttacgtacgctgtacacgatctgtttctatacctgcaccagcgtattatgctcacctggtagcatttagagccagatatcatcttgtggacaaagaacatgacagtgctgaaggaagtcacgtttcaggacaaagcaatgggcgagatccacaagctcttgccaaggctgtacagattcaccaagataccttacgcacaatgtacttcgcttaaatagtccaagtatattctctgagaggaagtactgaaagatgaattgacatacaacgtatgtttccagtgaagtcaattgagtaaggacacctccagccatacagaaaccaacactgtgtgggggccaaggtctgatccttatgttaacacaaggaagattgtttacttcatcaaggaacacagcatcattatgcaatatgaaaccagccaactgctttttgtgcggtctcctataggaagtatcgcaattgtcttgttttcatttcttgtagtctaacccttttaatgcctttacctcaagttgcttggcagcacaactatctttgcaaaaaaaagtaaagaaaaagtaaatgatggtttaaaaaat

SEQ ID NO: 772 - DNA, 4776 bp, Homo sapiens
ggcggcggcggcggcggcggcggcggggattgtttttgttgtcgctgaggccggaagagccggagccgggtccctgtccccgggccgggcgccgccgccgccccctgcccagcgcccgcgtctccgcggcgccaccccagcgccaatattccggagatcaagcgttacgcggcggcggcggcggcggcggcggggcccggagcgggaggcgccggggaccggggcgaggcggcccccgccgccgccatggaggcgctgggacccggacctccggctagcctgtttcagccacctcgtcgtcctggccttggaactgttggaaaaccaattcgactgttagccaatcattttcaggttcagattcctaaaatagatgtgtatcactatgatgtggatattaagcctgaaaaacggcctcgtagagtcaacagggaggtagtagatacaatggtgcggcacttcaagatgcaaatatttggtgatcggcagcctgggtatgatggcaaaagaaacatgtacacagcacatccactaccaattggacgggatagggttgatatggaggtgactcttccaggcgagggtaaagaccaaacatttaaagtgtctgttcagtgggtgtcagttgtgagccttcagttgcttttagaagctttggctgggcacttgaatgaagtcccagatgactcagtacaagcacttgatgttatcacaagacaccttccctccatgaggtacaccccagtgggccgttcctttttctcacccccggaaggttactaccaccctctgggagggggcagggaggtctggtttggttttcatcagtctgtgagacctgccatgtggaatatgatgctcaacattgatgtatctgcaactgctttctaccgggctcagcctatcattgagttcatgtgtgaggttttagacattcagaacatcaatgaacagaccaaacctctaacagactcccagcgtgtcaaatttaccaaagaaatcagaggtctcaaagttgaggtgacccactgtggacagatgaaacgaaaataccgagtttgtaatgtgactagacggccagccagtcatcaaacttttcctttgcagctagaaaacggtcaagctatggaatgtacagtagctcaatattttaagcaaaagtatagtctgcaactgaaatacccccatcttccctgtctccaagtgggacaagaacaaaagcatacatacttgccactcgaggtctgtaatatagtggcaggacagcgatgtatcaagaagctcacagacaatcagacttccacaatgatcaaagctacagcaagatctgctcctgacagacaggaagagatcagtagactggtgaagagcaacagtatggtgggtggacctgatccataccttaaagaatttggtattgttgtccacaatgaaatgacagagctcacaggcagggtacttccagcaccaatgctgcaatatggaggccggaataaaacagtagccacacccaaccagggtgtctgggacatgcgaggaaagcagttttatgctggcattgaaattaaagtttgggcagttgcttgttttgcacctcagaaacaatgtagggaagatttactaaagagtttcactgaccagctgcgtaaaatctctaaggatgcaggaatgcccatccagggtcagccatgtttctgcaagtatgcacaaggtgcagacagtgtggagcctatgtttaaacatctgaaaatgacttatgtgggcctacagctaatagtggttatcctgcctggaaagacaccagtatatgcggaggtgaaacgtgttggagatacccttctaggtatggccacacagtgtgtccaggtaaaaaatgtagtgaagacctcacctcaaaccctttccaatctttgcctgaagataaatgcaaaacttggaggaattaacaatgtgcttgtgcctcatcaaaggccctcggtgttccagcagcctgtcatcttcctgggagcggatgtcacacaccccccagcaggggatgggaagaaaccttccattgctgctgtggttggcagtatggatggccaccccagccggtactgtgccaccgttcgggtgcagacttcccggcaggagatctcccaagagctcctctacagtcaagaggtcatccaggacctgactaacatggttcgagagctgctgattcagttctacaaatccacacgcttcaaacccactcggatcatctattaccgtggaggggtatctgagggacaaatgaaacaggtagcttggccagaactaatagcaattcgaaaggcatgtattagcttggaagaagattaccggccaggaataacttatattgtggtgcaaaaaagacatcacacacgactcttctgtgcagataaaacagaaagggtagggaaaagtggcaatgtaccagcaggcactacagtggatagtaccatcacacatccatctgagtttgacttttacctctgtagtcatgcaggaattcagggaaccagccgtccctcacattaccaggtcttgtgggatgacaactgcttcactgcagatgaactccagctactgacttaccagctgtgtcacacctatgtgaggtgcactcgctccgtctctattccagcccctgcatattatgcccggcttgtagcatttagggcaaggtatcatctggtggataaagatcatgacaggcaatgcggaaggcagtcatgtgtcaggacagagcaacggccgggatcctcaggccttggctaaggctgtgcaaatccaccatgatacccagcacacgatgtattttgcctgagagtctcagaaaaagaactcaaccaatttggcaccccatgcagcctcaaaatgtttcaaatgcctaccgcctctagatcgagccacgttgacttcaggtggtcttctaccagcagctcggaatagttgcactgaatctatactttgcagcactgtctgatgcgtcaacaaaattgagccatttttttaaagtaatagatactaatagattatcttttctgatgcactggactgaatttttacctcaatgtgcaaaggctgatcagcctgaactttctaaaggactttacaagaagggtttctatggaatattttgctagctgtggtgttcaccgcatccctctagtcttagaagagaagattattccttttttctgtagtcattgagtggggtatatgcataagtgggagagaaaaaccaaacaatctacttcagttcagtgtaactatttaattgtgtgggtccatagactttttaatgaagatttctgactttgccactgtaaatgcctttaatgagcattaatttttgaaagttttacagagttttattagttttactactttatcttattgatctctgcagacttgtgctggtgcaagtacatgctgacaggcaatttgcactatatttggctgcagattcaaataggcagttctcttatttggtcgacttttgtgaatgtgtgacataaacagatgtaatgcatgtcacagtgacggagataacactgccatgataaaagtactcatgtttcccctatttggaaaaaaaaattgcttttagtatttttccaagttttcaaaagtgcccattttatgctgctgtgtggtttgttaaatctaaatgatttttaaacttttctcatagaaacttaactttggcaataaacattttttaaggtctctcctcttccttccccaacaatgtagttttctagatgagatttcagtatgattttatcagctatttcttatatatcataatctggcaatttctgaaaccagtcagaaaagacatatatttccatgcctttttaaagaattatttttacctgttttatattcacagttggtgtcctgtcactttgttttaaaataagctagaaccaggatgcttccttattggaaaggctttgccagtccttaaggtacaatgagtgatgctgcaacttgcaaatgtaccagcatttaaaatttcttttcctgggaatcaaggtaactcacacgactacttgcagtacaaattttttgcttctctttcgacatgaaatgtacttggtgggttttccttccttttattaaactaaaactgtgtggaaaaggttgatttttcttaatagattctggattccactcacagggagatgggattcctttcttgtccaaacaaagggagttgctctaaagcgagcatcagttaaaatgtaggggaaaatgtattctgtatgtagtgtagataatactttgtgaatggacaacagttacatagtgtcttggtagcaccagccagtgtttcccagcccagagtttactgacttgtaattctctatccaggacatcaggagtgagggatggaaaaggggataaaaggcctggagccacactctatatggctgaggaaggagctagggaaagagatagacacaatggggtgaaaacaattttgccgcccctgcctggaaactgctggtggggaaatgatggtgaagggtgtttgcttgaactcatgagacggtccaaatctcataaactagccttctcaaaatcccagcaatataaagcactgtttttcttcagtcgtttaaataaacttgtaaatacattgaagtttacatttccatgtgctgttgatcaacggcgccacctgtgtttgctgagactggtctctgagagagttttatgtcgatcgaggcctgttgctcattaagctgagtgcag

SEQ ID NO: 773 - DNA, 7478 bp, Homo sapiens
actggcagctggccgggcgctcgcagtgggagctgctgcaggctccgcggcggcggcaacggaggctgcgggggcggcggcgcgagcggccgggcttggtaggggagccgagcccggcccgggatcccgagcagcgagagtgtggggtacctaggcccctcacgctggacttcacagtctccgggccgcctgacctccgcacgggtatatgggatggaagcgggaccctcgggagcagctgcgggcgcttacctgccccccctgcagcaggtgttccaggcacctcgccggcctggcattggcactgtggggaaaccaatcaagctcctggccaattactttgaggtggacatccctaagatcgacgtgtaccactacgaggtggacatcaagccggataagtgtccccgtagagtcaaccgggaagtggtggaatacatggtccagcatttcaagcctcagatctttggtgatcgcaagcctgtgtatgatggaaagaagaacatttacactgtcacagcactgcccattggcaacgaacgggtcgactttgaggtgacaatccctggggaagggaaggatcgaatctttaaggtctccatcaagtggctagccattgtgagctggcgaatgctgcatgaggccctggtcagcggccagatccctgttcccttggagtctgtgcaagccctggatgtggccatgaggcacctggcatccatgaggtacacccctgtgggccgctccttcttctcaccgcctgagggctactaccacccgctggggggtgggcgcgaggtctggttcggctttcaccagtctgtgcgccctgccatgtggaagatgatgctcaacattgatgtctcagccactgccttttataaggcacagccagtgattgagttcatgtgtgaggtgctggacatcaggaacatagatgagcagcccaagcccctcacggactctcagcgcgttcgcttcaccaaggagatcaagggcctgaaggtggaagtcacccactgtggacagatgaagaggaagtaccgcgtgtgtaatgttacccgtcgccctgctagccatcagacattccccttacagctggagagtggacagactgtggagtgcacagtggcacagtatttcaagcagaaatataaccttcagctcaagtatccccatctgccctgcctacaagttggccaggaacaaaagcatacctaccttcccctagaggtctgtaacattgtggctgggcagcgctgtattaaaaagctgaccgacaaccagacctcgaccatgataaaggccacagctagatccgctccagacagacaggaggagatcagtcgcctgatgaagaatgccagctacaacttagatccctacatccaggaatttgggatcaaagtgaaggatgacatgacggaggtgacagggcgagtgctgccggcgcccatcttgcagtacggcggccggaaccgggccattgccacacccaatcagggtgtctgggacatgcgggggaaacagttctacaatgggattgagatcaaagtctgggccatcgcctgcttcgcaccccaaaaacagtgtcgagaagaggtgctcaagaacttcacagaccagctgcggaagatttccaaggatgcggggatgcctatccagggtcaaccttgtttctgcaaatatgcacagggggcagacagcgtggagcctatgttccggcatctcaagaacacctactcagggctgcagctcattattgtcatcctgccagggaagacgccggtgtatgctgaggtgaaacgtgtcggagatacactcttgggaatggctacgcagtgtgtgcaggtgaagaacgtggtcaagacctcacctcagactctgtccaacctctgcctcaagatcaatgtcaaacttggtggcattaacaacatcctagtcccacaccagcgctctgccgtttttcaacagccagtgatattcctgggagcagatgttacacaccccccagcaggggatgggaaaaaaccttctatcacagcagtggtaggcagtatggatgcccaccccagccgatactgtgctactgtgcgggtacagcgaccacggcaagagatcattgaagacttgtcctacatggtgcgtgagctcctcatccaattctacaagtccacccgtttcaagcctacccgcatcatcttctaccgagatggggtgcctgaaggccagctaccccagatactccactatgagctactggccattcgtgatgcctgcatcaaactggaaaaggactaccagcctgggatcacttatattgtggtgcagaaacgccatcacacccgccttttctgtgctgacaagaatgagcgaattgggaagagtggtaacatcccagctgggaccacagtggacaccaacatcacccacccatttgagtttgacttctatctgtgcagccacgcaggcatccagggcaccagccgaccatcccattactatgttctttgggatgacaaccgtttcacagcagatgagctccagatcctgacgtaccagctgtgccacacttacgtacgatgcacacgctctgtctctatcccagcacctgcctactatgcccgcctggtggctttccgggcacgataccacctggtggacaaggagcatgacagtggagaggggagccacatatcggggcagagcaatgggcgggacccccaggccctggccaaagccgtgcaggttcaccaggatactctgcgcaccatgtacttcgcttgaaggcagaacgctgttacctcactggatagaagaaagctttccaagccccaggagctgtgccacccaaatccagaggaagcaaggaggagggaggtggggtagggaggagtgtaggatgccttgtttccttctatagaggtggtgtaagagtggggaacagggccagcaagacagaccaccagccagaaatctctgatatcaacctcatgtcccccacccctcaccccatcttgtcacatctggccctgaccccactggaccaaaaggggcagcactggtgcccaccatacacacaggtgtctcatgtgactcacagtgctaaagactcatgcttgacagcttggtaaggtcaactctgtagccctgcagacaaaagctggttaggtttgggtttgatactttagatgggaaagtgaggggcttgagaaagtgggtgggaggagggaaggattttttaggagccttaatcagaaaaggactagatttgtttaagaagaaaaatgaaaccagacccagatcaatattttaggatactagatgttttaatgggttcagaatccagtttgtaggaagattttttaatggttttggttgctcctcccccagctgccaccccccaccttacccttattcctctctgtccacattttctgccccaccttacttctcctccctgacagacatccagcccctagtaatacttaaggcactatggcacttagctttgaagtgacacgaccctgtcttccttccgcccgctggtgggtaaccagtgccttccctgtaacggtaatgctgcagaactgcaaccttttgtacctttctttggggaatggggtgggggtgggagaggaggtagatggggaagaaataccccagacccaacaaacctccagccagaaagccagctattttgcatttgaaggaattgacttcctcattcattgagctttttaaaagatcacaacctcaagatggttaaaatccattgacatttgcactttcaaacatgacaagtctcggagctgctgagatgacaggcccctggcctttccacttatgcctccttttctccttattcctcctacctcccgccccgcccaggtctggagttactttcatagcatttttcactcttggcttcttttctcccttgatggtcaagtctcttatgtttcaatatttcttaactggggtgtcttataacaaaaaactcttaggtctaaaatgagaaaaaagagagaaaacaaaatgttatttttataccataacttgagtgtattgccaaaatttggaaatccttcccatgcctgatgagtttatatcccagaaacattgagccatcagaatgaactgtgtacctgatttgttctctgacctggctaggtagggagggggtggttatcgccccaagatggggtccaggctccatccttcctctgtgcagataatacctttttcttgctatagcctccctcctctgcactgtcctgcactctttcttgcaagtgcatctttttccttcccctggactgtcctctgaccctttggctcatcctagattgcagtgtgtcctgtggacaggctggggaattttgctgctccctattgcttctgtttacaaaaatgaatttttcctggtttcccactagggcatgtgggtgggtggcatggacttttttttttttttttttttgtcttgagacatggggtttggctgtcttgcaggactggagaaggtggtggttctagcttggtctctgttggccttgaagcaagcatcccccctgccctttttccttgactgttcatttttttcctgccccactgcttgggatggggagttgcaacttcagtgtggaatttcctctttgaggagcctgggcttggatctatcctgatctggtgatgaagccatgattactttagacctagcccaggcttggaggccagctggaggaagaagggtctaaatcctggcctgtagagttagaactaccatttcctccccttagctgcccttgtatgacccggatttgctatgcaaaacaatctatcccaggttctgttctggttggctacattgttcagcaactcacaaaacgtagcacaaacattcattatggagaaagcatcaggactgttgagtaactcctcctttacttttttcctgctggctacagcatggggtgccctataggcacaagcccagctgaagaacagaatggagggctctgggaggaggcagctcactggagagcctacattccttacacaagtgcctaaagagagtgatgctaacactccatctgccctgtccattgccttcatatacagtctacttcgtgttctgtcaccctttggggaggggagttctcctgggacagtgggctctgcatgttctccacttggatacattttggggctaggatcagggcactattcctggagggtccagtcattcaccagcatttgcaaatgtccatagggagcaggtggcagcctctactcccagcaacaagtttgtgttctctccttttctctctttgcctcactctctccagttggttttcagctggggcttgaaatgcatttttagccctttgacgtggcttatgccattcaagaaataaaaagcaagagaatcagctttgggcaatgacaagaaatgagttcttactctgatttttttgtaaaaagataatttttgagacttgaaaaataccccgaccttgagattattcctgtttgaaaggtggtgcatgcagatggagaagtggtgttggcagcaagctttggctcatgtggatttggtttaagtggtgcttcttacccaagcttcaaggaagtgcttgggggacccccagcctcatcctcttagttgggtctcttgttccctttgtaccactgttttgccttccttttcctcttctctctttgcctggcttcctttcccttttcttctattcactctgcttgcttgctggccggcctgcctgcctgcctgcctgcctgcctgcctgtctgcctatgtgatgatgaaatctctgcatggctgcaatgatcccactgttagctggcagggtcaggcttagctccttgactgcagaagaccaagaacctgttccccaagcccagagatgtccacctgggctggactgccctcaagcttatactagagaagagcaactgacctgcccaacttgtgtgaagtcaggagggtttctggcattttccacacctgtccactccttggagctggtttctctcattgctttttctaaatctggttctttttctctttacctggggcctggcttttctgagattgtcttagggttgagctatttgggtatcctgggtttgagtgttaggggatggacataaaggaaaaagagtgatgagaagagaatggagagaatttgaataaaaggtgggaaaggagagcactgttctttgattgtttatccagtccaacctgatccattagggatcgaggtgctacactggcctccagggataagcctggggctactgttgctgggaacttaggcttaacataaagccgaagaaggtacctagaaatttgaaacttccctaaaaagctcctaatgcccacctgctagatagcttctctgtggcctcctatttagctaagcagcagtgtttttggatactttttttttctgtttgtgaataaggccagcactcaagatgggcagccaagggtgcactgactattagctggcccataggatatctgtaaggctggtgggacagttttggacctggaatcatgtgtaactaacaaggttggacgtttcttccccatcagggtagaaaaatcatctcaaactagccaaaaggcagttttggaaactacattgggggacgttatttttatttatatatggggcctaggccaatccaggatggtagctggaataccttccttcttaaaatctgatcatggcagggatatgcagggcactttttactatttggccttctaagcagattgggaaggaggtattttctggttttcgctttcctccgacttaataggacttgccttctccctgggcagggagagaggctgggttggtgctctcccttactctactcatactgacttagagcctctggctgctgtttgggcatccaagaaagggaggggaaggaatgagctaaaaacaaaacagaatgaggtgggaaagggagattttcttctttacagaggaaaataggaaaccctccaagaattgtgcaagtaaagacatttgttgaatgcactgagtcccttggtgtagtagcaataaggaaaaatgaaattactttcctgtgcacacagtccagcctaattggtatgtgatgttgcacttagcagccatgtggtgggcatgtgtgactactctggttttcactttagtttctaaactttttatccctctcaagtccagcatggatggggaaatgtctctggatccccacagctgtgtacttgtttgcatttgtttccctttgagatttgtgtttgtgtcctgctttgagctgtaccttgtccagtccattgtgaaattatcccagcagctgtaatgtacagttccttctgaagcaagcaacatcagcagcagcagcagcagcagcacaattctgtgttttataaagacaacagtggcttctatttctaa

SEQ ID NO: 774 - DNA, 4185 bp, Homo sapiens
ggcgcgagtagtcctgcccctccgcgttgtctccggccggcacggcccggcggggtacggccgagcccgccgcatgtggcccggctcccggacacctccccggcgtcctccgcgccggccgctcctgccccgacgtcgctccggcacggctcggggcccagaggcgaggcgaggacgccgggcaagccaggcagcggaactgacgccggcgagcttccggggcggccccgggcaggtcggcggcggcggcccgcagtcgtggaggagcggtgggagcgtcggcggccgcgggcgatgcaacttccggacgggactcccctctgtccgcgcctcacatctccccttcctctcgcctagtcctgtgccgttttccgtccgcgactcttccggcccagagctttcggagtgcggttgctcaggggaagccgtcgccgcccccgcctcggggccgagtgagagtgcccgtcgcgtcgcgccgcgtcgccccccgggccgcctccttgccgccagtggcgggctccgttctccctcgaagcactccccccagctccatgaatggaaatcggctccgcaggacccgctggggcccagcccctactcatggtgcccagaagacctggctatggcaccatgggcaaacccattaaactgctggctaactgttttcaagttgaaatcccaaagattgatgtctacctctatgaggtagatattaaaccagacaagtgtcctaggagagtgaacagggaggtggttgactcaatggttcagcattttaaagtaactatatttggagaccgtagaccagtttatgatggaaaaagaagtctttacaccgccaatccacttcctgtggcaactacaggggtagatttagacgttactttacctggggaaggtggaaaagatcgacctttcaaggtgtcaatcaaatttgtctctcgggtgagttggcacctactgcatgaagtactgacaggacggaccttgcctgagccactggaattagacaagccaatcagcactaaccctgtccatgccgttgatgtggtgctacgacatctgccctccatgaaatacacacctgtggggcgttcatttttctccgctccagaaggatatgaccaccctctgggagggggcagggaagtgtggtttggattccatcagtctgttcggcctgccatgtggaaaatgatgcttaatatcgatgtttctgccactgccttctacaaagcacaacctgtaattcagttcatgtgtgaagttcttgatattcataatattgatgagcaaccaagacctctgactgattctcatcgggtaaaattcaccaaagagataaaaggtttgaaggttgaagtgactcattgtggaacaatgagacggaaataccgtgtttgtaatgtaacaaggaggcctgccagtcatcaaacctttcctttacagttagaaaacggccaaactgtggagagaacagtagcgcagtatttcagagaaaagtatactcttcagctgaagtacccgcaccttccctgtctgcaagtcgggcaggaacagaaacacacctacctgccactagaagtctgtaatattgtggcagggcaacgatgtatcaagaagctaacagacaatcagacttccactatgatcaaggcaacagcaagatctgcaccagatagacaagaggaaattagcagattggtaagaagtgcaaattatgaaacagatccatttgttcaggagtttcaatttaaagttcgggatgaaatggctcatgtaactggacgcgtacttccagcacctatgctccagtatggaggacggaatcggacagtagcaacaccgagccatggagtatgggacatgcgagggaaacaattccacacaggagttgaaatcaaaatgtgggctatcgcttgttttgccacacagaggcagtgcagagaagaaatattgaagggtttcacagaccagctgcgtaagatttctaaggatgcagggatgcccatccagggccagccatgcttctgcaaatatgcacagggggcagacagcgtagagcccatgttccggcatctcaagaacacatattctggcctacagcttattatcgtcatcctgccggggaagacaccagtgtatgcggaagtgaaacgtgtaggagacacacttttgggtatggctacacaatgtgttcaagtcaagaatgtaataaaaacatctcctcaaactctgtcaaacttgtgcctaaagataaatgttaaactcggagggatcaataatattcttgtacctcatcaaagaccttctgtgttccagcaaccagtgatctttttgggagccgatgtcactcatccacctgctggtgatggaaagaagccttctattgctgctgttgtaggtagtatggatgcacacccaagcagatactgtgccacagtaagagttcagagaccccgacaggagatcatccaggacttggcctccatggtccgggaacttcttattcaattttataagtcaactcggttcaagcctactcgtatcatcttttatcgggatggtgtttcagaggggcagtttaggcaggtattatattatgaactactagcaattcgagaagcctgcatcagtttggagaaagactatcaacctggaataacctacattgtagttcagaagagacatcacactcgattattttgtgctgataggacagaaagggttggaagaagtggcaatatcccagctggaacaacagttgatacagacattacacacccatatgagttcgatttttacctctgtagccatgctggaatacagggtaccagtcgtccttcacactatcatgttttatgggatgataactgctttactgcagatgaacttcagctgctaacttaccagctctgccacacttacgtacgctgtacacgatctgtttctatacctgcaccagcgtattatgctcacctggtagcatttagagccagatatcatcttgtggacaaagaacatgacagtgctgaaggaagtcacgtttcaggacaaagcaatgggcgagatccacaagctcttgccaaggctgtacagattcaccaagataccttacgcacaatgtacttcgcttaaatagtccaagtatattctctgagaggaagtactgaaagatgaattgacatacaacgtatgtttccagtgaagtcaattgagtaaggacacctccagccatacagaaaccaacactgtgtgggggccaaggtctgatccttatgttaatacaaggaagattgtttacttcatcaaggaacacagcatcattatgcaatatgaaaccagccaactgctttttgtgcggtctcctataggaagtatcgcaattgttttgttttcatttcttgtagtctaacccttttaatgcctttacctcaagttgcttggcagcacaactatctttgcaaaaaaaagtaaagaaaaagtaaatgatggtttaaaaaatacacaccttcatgaataatcaaagtgatttttcagaattatgtgtgcaaaaaattaatgtgcattcatatattcttgtaaaaggtgtctgtgtatttttaaaatatatacatccatacttcatatgcatatatatctagatctggattgataatagatatatatgtgtctgttatatattttagagttcattccattggggaattttctttcccttttattctacccccactaccgcctttatttctctatttcccttgccttcatcacctacatttttttcccagtcctaccagtgacattcaaatgttgatgtatctggttcgtttgaatataaaatatggcaaactagaattctacttttattttgcataccctactcctgactcctatctcatacacaattctgagttctcaactcttgatattgctgtcttaagaaacaaaattttatatatatatgtatacatacatacacagacacagacacacacatatatatacataaaataactttctgtgagagtgcgtctctcccctcccactcagaacatacatttaccatttgcgcaatttgtatataagcagtagcaacctgaactattctttttcttttttctttttcttttctttcttttttttttttaatgagacagagcctcgctctgtcaccaggctgga

SEQ ID NO: 775 - DNA, 7478 bp, Homo sapiens; identical to SEQ ID NO: 773

SEQ ID NO: 776 - DNA, 4473 bp, Homo sapiens
acgccggcgagcttccggggcggccccgggcaggtcggcggcggcggcccgcagtcgtggaggagcggtgggagcgtcggcggccgcgggcgatgcaacttccggacgggactcccctctgtccgcgcctcacatctccccttcctctcgcctagtcctgtgccgttttccgtccgcgactcttccggcccagagctttcggagtgcggttgctcaggggaagccgtcgccgcccccgcctcggggccgagtgagagtgcccgtcgcgtcgcgccgcgtcgccccccgggccgcctccttgccgccagtggcgggctccgttctccctcgaagcactccccccagctccatgaatggaaatcggctccgcaggacccgctggggcccagcccctactcatggtgcccagaagacctggctatggcaccatgggcaaacccattaaactgctggctaactgttttcaagttgaaatcccaaagattgatgtctacctctatgaggtagatattaaaccagacaagtgtcctaggagagtgaacagggaggtggttgactcaatggttcagcattttaaagtaactatatttggagaccgtagaccagtttatgatggaaaaagaagtctttacaccgccaatccacttcctgtggcaactacaggggtagatttagacgttactttacctggggaaggtggaaaagatcgacctttcaaggtgtcaatcaaatttgtctctcgggtgagttggcacctactgcatgaagtactgacaggacggaccttgcctgagccactggaattagacaagccaatcagcactaaccctgtccatgccgttgatgtggtgctacgacatctgccctccatgaaatacacacctgtggggcgttcatttttctccgctccagaaggatatgaccaccctctgggagggggcagggaagtgtggtttggattccatcagtctgttcggcctgccatgtggaaaatgatgcttaatatcgatgtttctgccactgccttctacaaagcacaacctgtaattcagttcatgtgtgaagttcttgatattcataatattgatgagcaaccaagacctctgactgattctcatcgggtaaaattcaccaaagagataaaaggtttgaaggttgaagtgactcattgtggaacaatgagacggaaataccgtgtttgtaatgtaacaaggaggcctgccagtcatcaaacctttcctttacagttagaaaacggccaaactgtggagagaacagtagcgcagtatttcagagaaaagtatactcttcagctgaagtacccgcaccttccctgtctgcaagtcgggcaggaacagaaacacacctacctgccactagaagtctgtaatattgtggcagggcaacgatgtatcaagaagctaacagacaatcagacttccactatgatcaaggcaacagcaagatctgcaccagatagacaagaggaaattagcagattggtaagaagtgcaaattatgaaacagatccatttgttcaggagtttcaatttaaagttcgggatgaaatggctcatgtaactggacgcgtacttccagcacctatgctccagtatggaggacggaatcggacagtagcaacaccgagccatggagtatgggacatgcgagggaaacaattccacacaggagttgaaatcaaaatgtgggctatcgcttgttttgccacacagaggcagtgcagagaagaaatattgaagggtttcacagaccagctgcgtaagatttctaaggatgcagggatgcccatccagggccagccatgcttctgcaaatatgcacagggggcagacagcgtagagcccatgttccggcatctcaagaacacatattctggcctacagcttattatcgtcatcctgccggggaagacaccagtgtatgcggaagtgaaacgtgtaggagacacacttttgggtatggctacacaatgtgttcaagtcaagaatgtaataaaaacatctcctcaaactctgtcaaacttgtgcctaaagataaatgttaaactcggagggatcaataatattcttgtacctcatcaaagaccttctgtgttccagcaaccagtgatctttttgggagccgatgtcactcatccacctgctggtgatggaaagaagccttctattgctgctgttgtaggtagtatggatgcacacccaagcagatactgtgccacagtaagagttcagagaccccgacaggagatcatccaggacttggcctccatggtccgggaacttcttattcaattttataagtcaactcggttcaagcctactcgtatcatcttttatcgggatggtgtttcagaggggcagtttaggcaggtattatattatgaactactagcaattcgagaagcctgcatcagtttggagaaagactatcaacctggaataacctacattgtagttcagaagagacatcacactcgattattttgtgctgataggacagaaagggttggaagaagtggcaatatcccagctggaacaacagttgatacagacattacacacccatatgagttcgatttttacctctgtagccatgctggaatacagggtaccagtcgtccttcacactatcatgttttatgggatgataactgctttactgcagatgaacttcagctgctaacttaccagctctgccacacttacgtacgctgtacacgatctgtttctatacctgcaccagcgtattatgctcacctggtagcatttagagccagatatcatcttgtggacaaagaacatgacagtgctgaaggaagtcacgtttcaggacaaagcaatgggcgagatccacaagctcttgccaaggctgtacagattcaccaagataccttacgcacaatgtacttcgcttaaatagtccaagtatattctctgagaggaagtactgaaagatgaattgacatacaacgtatgtttccagtgaagtcaattgagtaaggacacctccagccatacagaaaccaacactgtgtgggggccaaggtctgatccttatgttaatacaaggaagattgtttacttcatcaaggaacacagcatcattatgcaatatgaaaccagccaactgctttttgtgcggtctcctataggaagtatcgcaattgttttgttttcatttcttgtagtctaacccttttaatgcctttacctcaagttgcttggcagcacaactatctttgcaaaaaaaagtaaagaaaaagtaaatgatggtttaaaaaatacacaccttcatgaataatcaaagtgatttttcagaattatgtgtgcaaaaaattaatgtgcattcatatattcttgtaaaaggtgtctgtgtatttttaaaatatatacatccatacttcatatgcatatatatctagatctggattgataatagatatatatgtgtctgttatatattttagagttcattccattggggaattttctttcccttttattctacccccactaccgcctttatttctctatttcccttgccttcatcacctacatttttttcccagtcctaccagtgacattcaaatgttgatgtatctggttcgtttgaatataaaatatggcaaactagaattctacttttattttgcataccctactcctgactcctatctcatacacaattctgagttctcaactcttgatattgctgtcttaagaaacaaaattttatatatatatgtatacatacatacacagacacagacacacacatatatatacataaaataactttctgtgagagtgcgtctctcccctcccactcagaacatacatttaccatttgcgcaatttgtatataagcagtagcaacctgaactattctttttcttttttctttttcttttctttcttttttttttttaatgagacagagcctcgctctgtcaccaggctggagcaggattgcttgaacctaggaggcggaagttacagtgagccaagactgcaccattgcactccagcctgggcaacaaaaccaaaactccgtctcaaaagaaaaaaaaatcataatgaaaatgaacttaacatatttaaattatttgcaaatagattgtgtttattgaagaatcatattggctagatgcccattttcatttactaaaatgaatcaggaaaatgcaagatgatattttaaaacttttgctaatgtatcaccagtataactttccttttaaaattaaggtgatagtaacaaaggaagttaggactttgatcattttaaatcagttaaatcactgaaacgtgggaaattgttttacaaaacttttattgattacactttaaggtattaaaaagtactataaagctatcaaaactgagtttatcagtaacattggattcaggggagctttgcactttgtaactcatgaaaattgcattttgattt

SEQ ID NO: 777 - DNA, 2184 bp, Homo sapiens
cgaccggaagtccggtcactctcgcgaggccccagagagcaggcgctgggcagtgtggaggtcgttggagtcacttccccgtcaccagctcctgtgcctgccagtcggtgcccctcccgctccagccatgctctccgccctcgcccggcctgccagcgctgctctccgccgcagcttcagcacctcggcccagaacaatgctaaagtagctgtgctaggggcctctggaggcatcgggcagccactttcacttctcctgaagaacagccccttggtgagccgcctgaccctctatgatatcgcgcacacacccggagtggccgcagatctgagccacatcgagaccaaagccgctgtgaaaggctacctcggacctgaacagctgcctgactgcctgaaaggttgtgatgtggtagttattccggctggagtccccagaaagccaggcatgacccgggacgacctgttcaacaccaatgccacgattgtggccaccctgaccgctgcctgtgcccagcactgcccggaagccatgatctgcgtcattgccaatccggttaattccaccatccccatcacagcagaagttttcaagaagcatggagtgtacaaccccaacaaaatcttcggcgtgacgaccctggacatcgtcagagccaacacctttgttgcagagctgaagggtttggatccagctcgagtcaacgtccctgtcattggtggccatgctgggaagaccatcatccccctgatctctcagtgcacccccaaggtggactttccccaggaccagctgacagcactcactgggcggatccaggaggccggcacggaggtggtcaaggctaaagccggagcaggctctgccaccctctccatggcgtatgccggcgcccgctttgtcttctcccttgtggatgcaatgaatggaaaggaaggtgttgtggaatgttccttcgttaagtcacaggaaacggaatgtacctacttctccacaccgctgctgcttgggaaaaagggcatcgagaagaacctgggcatcggcaaagtctcctcttttgaggagaagatgatctcggatgccatccccgagctgaaggcctccatcaagaagggggaagatttcgtgaagaccctgaagtgagccgctgtgacgggtggccagtttccttaatttatgaaggcatcatgtcactgcaaagccgttgcagataaactttgtattttaatttgctttggtgatgattactgtattgacatcatcatgccttccaaattgtgggtggctctgtgggcgcatcatttcttccctgtgagagccaactttagagtgtctgctacctcttcattaccaatcagaattagatgatgtttaactgttagactgaagcgtgacgctttcatcagtagcttcaagaaagtctaaattgttaatttatggaattggacacagtattcagtttacccgtacatgctcctcccgcccctcctgttggcacccttgcatcgcccaggcctgattcctcctgggggtagttcacccccacgggttcatagttcagcggcgaatgccaggcagctgttttctggctgagcaaacagcacctttctcattgagcttcctctactgacctctgtcccccttgggatttcatcttctgaccgaaccctgatgttcagtggcagagacagcccatagccagaactgtgggtagaccagggttggggtgtgcggtttgggacagcccaaaccccagccgctgtgtcaaggcctaggacgccatgctgccatcaaaagggggttccaggtttccatcagtggcctaaagaagggacttcttgttgtactgaggagtgcggaattaaagagatttgactccctttagtattgggggcagtccgttccccagacactgtggcctctgaagtggaaactgaaagctgcatacctgggaaagaactttctaggaataggcaatggccttcagtggaagagggagggctggaggtgtgcccagtacttggatgttcatctgtccacaacagctttttgtttttttaaaaaagctaaaatggaaatggattttatcataaaggatgacatcgttttcttctacaattaatacatgttcattgtataaaacccaaaaagcagctaaaaaataaagcgggaaaggaactact

SEQ ID NO: 778 - DNA, 1244 bp, Homo sapiens
gccagtcggtgcccctcccgctccagccatgctctccgccctcgcccggcctgtcagcgctgctctccgccgcagcttcagcacctcggcccagaacaatgctaaagtagctgtgctaggggcctctggaggcatcgggcagccactttcacttctcctgaagaacagccccttggtgagccgcctgaccctctatgatatcgcgcacacacccggagtggccgcagatctgagccacatcgagaccaaagccgctgtgaaaggctacctcggacctgaacagctgcctgactgcctgaaaggttgtgatgtggtagttattccggctggagtccccagaaagccaggcatgacccgggacgacctgttcaacaccaatgccacgattgtggccaccctgaccgctgcctgtgcccagcactgcccggaagccatgatctgcgtcattgccaatccggttaattccaccatccccatcacagcagaagttttcaagaagcatggagtgtacaaccccaacaaaatcttcggcgtgacgaccctggacatcgtcagagccaacacctttgttgcagagctgaagggtttggatccagctcgagtcaacgtccctgtcattggtggccatgctgggaagaccatcatccccctgatctctcagtgcacccccaaggtggactttccccaggaccagctgacagcactcactgggcggatccaggaggccggcacggaggtggtcaaggctaaagccggagcaggctctgccaccctctccatggcgtatgccggcgcccgctttgtcttctcccttgtggatgcaatgaatggaaaggaaggtgttgtggaatgttccttcgttaagtcacaggaaacggaatgtacctacttctccacaccgctgctgcttgggaaaaagggcatcgagaagaacctgggcatcggcaaagtctcctcttttgaggagaagatgatctcggatgccatccccgagctgaaggcctccatcaagaagggggaagatttcgtgaagaccctgaagtgagccgctgtgacgggtggccagtttccttaatttatgaaggcatcatgtcactgcaaagccgttgcagataaactttgtattttaatttgctttggtgatgattactgtattgacatcatcatgccttccaaattgtgggtggctctgtgggcgcatcaataaaagccgtccttgattttaaaaaaaaaaaaaaaaaaaa

SEQ ID NO: 779 - DNA, 1321 bp, Homo sapiens
ggcgctgggcagtgtggaggtcgttggagtcacttccgcgtcaccagctcctgtgcctgccagtcggtgcccctcccgctccagccatgctctccgccctcgcccggcctgccagcgctgctctccgccgcagcttcagcacctcggcccagaacaatgctaaagtagctgtgctaggggcctctggaggcatcgggcagccactttcacttctcctgaagaacagccccttggtgagccgcctgaccctctatgatatcgcgcacacacccggagtggccgcagatctgagccacatcgagaccaaagccgctgtgaaaggctacctcggacctgaacagctgcctgactgcctgaaaggttgtgatgtggtagttattccggctggagtccccagaaagccaggcatgacccgggacgacctgttcaacaccaatgccacgattgtggccaccctgaccgctgcctgtgcccagcactgcccggaagccatgatctgcgtcattgccaatccggttaattccaccatccccatcacagcagaagttttcaagaagcatggagtgtacaaccccaacaaaatcttcggcgtgacgaccctggacatcgtcagagccaacacctttgttgcagagctgaagggtttggatccagctcgagtcaacgtccctgtcattggtggccatgctgggaagaccatcatccccctgatctctcagtgcacccccaaggtggactttccccaggaccagctgacagcactcactgggcggatccaggaggccggcacggaggtggtcaaggctaaagccggagcaggctctgccaccctctccatggcgtatgccggcgcccgctttgtcttctcccttgtggatgcaatgaatggaaaggaaggtgttgtggaatgttccttcgttaagtcacaggaaacggaatgtacctacttctccacaccgctgctgcttgggaaaaagggcatcgagaagaacctgggcatcggcaaagtctcctcttttgaggagaagatgatctcggatgccatccccgagctgaaggcctccatcaagaagggggaagatttcgtgaagaccctgaagtgagccgctgtgacgggtggccagtttccttaatttatgaaggcatcatgtcactgcaaagccgttgcagataaactttgtattttaatttgctttggtgatgattactgtattgacatcatcatgccttccaaattgtgggtggctctgtgggcgcatcaataaaagccgtccttgattttatttttcaaggtcccttctgtaaaaaaaaaaaaaaaaaa

SEQ ID NO: 780 - DNA, 2237 bp, Homo sapiens
cgaccggaagtccggtcactctcgcgaggccccagagagcaggcgctgggcagtgtggaggtcgttggagtcacttccccgtcaccagctcctgtgcctgccagtcggtgcccctcccgctccagccatgctctccgccctcgcccggcctgccagcgctgctctccgccgcagcttcagcacctcggcccagaacaatgctaaagtagctgtgctaggggcctctggaggcatcgggcagccactttcacttctcctgaagaacagccccttggtgagccgcctgaccctctatgatatcgcgcacacacccggagtggccgcagatctgagccacatcgagaccaaagccgctgtgaaaggctacctcggacctgaacagctgcctgactgcctgaaaggttgtgatgtggtagttattccggctggagtccccagaaagccaggcatgacccgggacgacctgttcaacaccaatgccacgattgtggccaccctgaccgctgcctgtgcccagcactgcccggaagccatgatctgcgtcattgccaatccggttaattccaccatccccatcacagcagaagttttcaagaagcatggagtgtacaaccccaacaaaatcttcggcgtgacgaccctggacatcgtcagagccaacacctttgttgcagagctgaagggtttggatccagctcgagtcaacgtccctgtcattggtggccatgctgggaagaccatcatccccctgatctctcagtgcacccccaaggtggactttccccaggaccagctgacagcactcactgggcggatccaggaggccggcacggaggtggtcaaggctaaagccggagcaggctctgccaccctctccatggcgtatgccggcgcccgctttgtcttctcccttgtggatgcaatgaatggaaaggaaggtgttgtggaatgttccttcgttaagtcacaggaaacggaatgtacctacttctccacaccgctgctgcttgggaaaaagggcatcgagaagaacctgggcatcggcaaagtctcctcttttgaggagaagatgatctcggatgccatccccgagctgaaggcctccatcaagaagggggaagatttcgtgaagaccctgaagtgagccgctgtgacgggtggccagtttccttaatttatgaaggcatcatgtcactgcaaagccgttgcagataaactttgtattttaatttgctttggtgatgattactgtattgacatcatcatgccttccaaattgtgggtggctctgtgggcgcatcaataaaagccgtccttgattttatttttcaaggtcccttctgtaaatgctgtgctttcttccctgtgagagccaactttagagtgtctgctacctcttcattaccaatcagaattagatgatgtttaactgttagactgaagcgtgacgctttcatcagtagcttcaagaaagtctaaattgttaatttatggaattggacacagtattcagtttacccgtacatgctcctcccgcccctcctgttggcacccttgcatcgcccaggcctgattcctcctgggggtagttcacccccacgggttcatagttcagcggcgaatgccaggcagctgttttctggctgagcaaacagcacctttctcattgagcttcctctactgacctctgtcccccttgggatttcatcttctgaccgaaccctgatgttcagtggcagagacagcccatagccagaactgtgggtagaccagggttggggtgtgcggtttgggacagcccaaaccccagccgctgtgtcaaggcctaggacgccatgctgccatcaaaagggggttccaggtttccatcagtggcctaaagaagggacttcttgttgtactgaggagtgcggaattaaagagatttgactccctttagtattgggggcagtccgttccccagacactgtggcctctgaagtggaaactgaaagctgcatacctgggaaagaactttctaggaataggcaatggccttcagtggaagagggagggctggaggtgtgcccagtacttggatgttcatctgtccacaacagctttttgtttttttaaaaaagctaaaatggaaatggattttatcataaaggatgacatcgttttcttctacaattaatacatgttcattgtataaaacccaaaaagcagctaaaaaataaagcgggaaaggaactact

SEQ ID NO: 781 - DNA, 2887 bp, Homo sapiens
ccacgcgtccgagcaagaacagctaaaatgaaagccatcattcatcttactcttcttgctctcctttctgtaaacacagccaccaaccaaggcaactcagctgatgctgtaacaaccacagaaactgcgactagtggtcctacagtagctgcagctgataccactgaaactaatttccctgaaactgctagcaccacagcaaatacaccttctttcccaacagctacttcacctgctccccccataattagtacacatagttcctccacaattcctacacctgctccccccataattagtacacatagttcctccacaattcctatacctactgctgcagacagtgagtcaaccacaaatgtaaattcattagctacctctgacataatcaccgcttcatctccaaatgatggattaatcacaatggttccttctgaaacacaaagtaacaatgaaatgtcccccaccacagaagacaatcaatcatcagggcctcccactggcaccgctttattggagaccagcaccctaaacagcacaggtcccagcaatccttgccaagatgatccctgtgcagataattcgttatgtgttaagctgcataatacaagtttttgcctgtgtttagaagggtattactacaactcttctacatgtaagaaaggaaaggtattccctgggaagatttcagtgacagtatcagaaacatttgacccagaagagaaacattccatggcctatcaagacttgcatagtgaaattactagcttgtttaaagatgtatttggcacatctgtttatggacagactgtaattcttactgtaagcacatctctgtcaccaagatctgaaatgcgtgctgatgacaagtttgttaatgtaacaatagtaacaattttggcagaaaccacaagtgacaatgagaagactgtgactgagaaaattaataaagcaattagaagtagctcaagcaactttctaaactatgatttgacccttcggtgtgattattatggctgtaaccagactgcggatgactgcctcaatggtttagcatgcgattgcaaatctgacctgcaaaggcctaacccacagagccctttctgcgttgcttccagtctcaagtgtcctgatgcctgcaacgcacagcacaagcaatgcttaataaagaagagtggtggggcccctgagtgtgcgtgcgtgcccggctaccaggaagatgctaatgggaactgccaaaagtgtgcatttggctacagtggactcgactgtaaggacaaatttcagctgatcctcactattgtgggcaccatcgctggcattgtcattctcagcatgataattgcattgattgtcacagcaagatcaaataacaaaacgaagcatattgaagaagagaacttgattgacgaagactttcaaaatctaaaactgcggtcgacaggcttcaccaatcttggagcagaagggagcgtctttcctaaggtcaggataacggcctccagagacagccagatgcaaaatccctattcaagacacagcagcatgccccgccctgactattagaatcataagaatgtggaacccgccatggcccccaaccaatgtacaagctattatttagagtgtttagaaagactgatggagaagtgagcaccagtaaagatctggcctccggggtttttcttccatctgacatctgccagcctctctgaatggaagttgtgaatgtttgcaacgaatccagctcacttgctaaataagaatctatgacattaaatgtagtagatgctattagcgcttgtcagagaggtggttttcttcaatcagtacaaagtactgagacaatggttagggttgttttcttaattcttttcctggtagggcaacaagaaccatttccaatctagaggaaagctccccagcattgcttgctcctgggcaaacattgctcttgagttaagtgacctaattcccctgggagacatacgcatcaactgtggaggtccgaggggatgagaagggatacccaccacctttcaagggtcacaagctcactctctgacaagtcagaatagggacactgcttctatccctccaatggagagattctggcaacctttgaacagcccagagcttgcaacctagcctcacccaagaagactggaaagagacatatctctcagctttttcaggaggcgtgcctgggaatccaggaactttttgatgctaattagaaggcctggactaaaaatgtccactatggggtgcactctacagtttttgaaatgctaggaggcagaaggggcagagagtaaaaaacatgacctggtagaaggaagagaggcaaaggaaactgggtggggaggatcaattagagaggaggcacctgggatccaccttcttccttaggtcccctcctccatcagcaaaggagcacttctctaatcatgccctcccgaagactggctgggagaaggtttaaaaacaaaaaatccaggagtaagagccttaggtcagtttgaaattggagacaaactgtctggcaaagggtgcgagagggagcttgtgctcaggagtccagccgtccagcctcggggtgtaggtttctgaggtgtgccattggggcctcagccttctctggtgacagaggctcagctgtggccaccaacacacaaccacacacacacaaccacacacacaaatgggggcaaccacatccagtacaagcttttacaaatgttattagtgtccttttttatttctaatgccttgtcctcttaaaagttattttatttgttattattatttgttcttgactgttaattgtgaatggtaatgcaataaagtgcctttgttagatggtgaaaaaaaaaaaaaaaaaaaa

SEQ ID NO: 782 - DNA, 2859 bp, Homo sapiens
ccaagcaagaacagctaaaatgaaagccatcattcatcttactcttcttgctctcctttctgtaaacacagtcaccaaccaaggcaactcagctgatgctgtaacaaccacagaaactgcgactagtggtcctacagtagctgcagctgataccactgaaactaatttccctgaaactgctagcaccacagcaaatacaccttctttcccaacagctacttcacctgctccccccataattagtacacatagttcctccacaattcctacacctgctccccccataattagtacacatagttcctccacaattcctacacctactgctgcagacagtgagtcaaccacaaatgtaaattcattagctacctctgacataatcaccgcttcatctccaaatgatggattaatcacaatggttccttctgaaacacaaagtaacaatgaaatgtcccccaccacagaagacaatcaatcatcagggcctcccactggcaccgctttattggagaccagcaccctaaacagcacaggtcccagcaatccttgccaagatgatccctgtgcagataattcgttatgtgttaagctgcataatacaagtttttgcctgtgtttagaagggtattactacaactcttctacatgtaagaaaggaaaggtattccctgggaagatttcagtgacagtatcagaaacatttgacccagaagagaaacattccatggcctatcaagacttgcatagtgaaattactagcttgtttaaagatgtatttggcacatctgtttatggacagactgtaattcttactgtaagcacatctctgtcaccaagatctgaaatgcgtgctgatgacaagtttgttaatgtaacaatagtaacaattttggcagaaaccacaagtgacaatgagaagactgtgactgagaaaattaataaagcaattagaagtagctcaagcaactttctaaactatgatttgacccttcggtgtgattattatggctgtaaccagactgcggatgactgcctcaatggtttagcatgcgattgcaaatctgacctgcaaaggcctaacccacagagccctttctgcgttgcttccagtctcaagtgtcctgatgcctgcaacgcacagcacaagcaatgcttaataaagaagagtggtggggcccctgagtgtgcgtgcgtgcccggctaccaggaagatgctaatgggaactgccaaaagtgtgcatttggctacagtggactcgactgtaaggacaaatttcagctgatcctcactattgtgggcaccatcgctggcattgtcattctcagcatgataattgcattgattgtcacagcaagatcaaataacaaaacgaagcatattgaagaagagaacttgattgacgaagactttcaaaatctaaaactgcggtcgacaggcttcaccaatcttggagcagaagggagcgtctttcctaaggtcaggataacggcctccagagacagccagatgcaaaatccctattcaagacacagcagcatgccccgccctgactattagaatcataagaatgtggaacccgccatggcccccaaccaatgtacaagctattatttagagtgtttagaaagactgatggagaagtgagcaccagtaaagatctggcctccggggtttttcttccatctgacatctgccagcctctctgaatggaagttgtgaatgtttgcaacgaatccagctcacttgctaaataagaatctatgacattaaatgtagtagatgctattagcgcttgtcagagaggtggttttcttcaatcagtacaaagtactgagacaatggttagggttgttttcttaattcttttcctggtagggcaacaagaaccatttccaatctagaggaaagctccccagcattgcttgctcctgggcaaacattgctcttgagttaagtgacctaattcccctgggagacatacgcatcaactgtggaggtccgaggggatgagaagggatacccaccacctttcaagggtcacaagctcactctctgacaagtcagaatagggacactgcttctatccctccaatggagagattctggcaacctttgaacagcccagagcttgcaacctagcctcacccaagaagactggaaagagacatatctctcagctttttcaggaggcgtgcctgggaatccaggaactttttgatgctaattagaaggcctggactaaaaatgtccactatggggtgcactctacagtttttgaaatgctaggaggcagaaggggcagagagtaaaaaacatgacctggtagaaggaagagaggcaaaggaaactgggtggggaggatcaattagagaggaggcacctgggatccaccttcttccttaggtcccctcctccatcagcaaaggagcacttctctaatcatgccctcccgaagactggctgggagaaggtttaaaaacaaaaaatccaggagtaagagccttaggtcagtttgaaattggagacaaactgtctggcaaagggtgcgagagggagcttgtgctcaggagtccagccgtccagcctcggggtgtaggtttctgaggtgtgccattggggcctcagccttctctggtgacagaggctcagctgtggccaccaacacacaaccacacacacacaaccacacacacaaatgggggcaaccacatccagtacaagcttttacaaatgttattagtgtccttttttatttctaatgccttgtcctcttaaaagttattttatttgttattattatttgttcttgactgttaattgtgaatggtaatgcaataaagtgcctttgttagatggtg

SEQ ID NO: 783 - DNA, 3631 bp, Homo sapiens
gcttcccatacggcagtggctgggggagagtgatggagagaaaggctaagctaaggtcaaagaaagtggaggaaggctggcttgtcccgctggacttgacggcggagctgctgcaatctcgcgggctgggcccttgccccgggtggacccgagtgcctgcggggaggcgggtgtggctcccccgggaggtgacagctggcggggcccgtaaggagctggtctgctccggctcccctctcgtagccggcgccctgggaccagcgcgtgagcacgtctcggaggagtccgatgcgctgggcagggccgggtggtcacccccgcccagcttccaggggtgactgtgcctctgacgtcagacggtttttgggtcattccctggcacggggactttattttcataacagcatgaagtgccgtggaactggaataggcgtgtcctctccctcgaccctccccctccttgtccctctgctcacccctcgctcgttccctccctccggcgagggccgcctttataacaactgctcagagtgcgagggcgggatagctgtccaaggtctcccccagcactgaggagctcgcctgctgccctcttgcgcgcgggaagcagcaccaagttcacggccaacgccttggcactagggtccagaatggctacaacagtccctgatggttgccgcaatggcctgaaatccaagtactacagactttgtgataaggctgaagcttggggcatcgtcctagaaacggtggccacagccggggttgtgacctcggtggccttcatgctcactctcccgatcctcgtctgcaaggtgcaggactccaacaggcgaaaaatgctgcctactcagtttctcttcctcctgggtgtgttgggcatctttggcctcaccttcgccttcatcatcggactggacgggagcacagggcccacacgcttcttcctctttgggatcctcttttccatctgcttctcctgcctgctggctcatgctgtcagtctgaccaagctcgtccgggggaggaagcccctttccctgttggtgattctgggtctggccgtgggcttcagcctagtccaggatgttatcgctattgaatatattgtcctgaccatgaataggaccaacgtcaatgtcttttctgagctttccgctcctcgtcgcaatgaagactttgtcctcctgctcacctacgtcctcttcttgatggcgctgaccttcctcatgtcctccttcaccttctgtggttccttcacgggctggaagagacatggggcccacatctacctcacgatgctcctctccattgccatctgggtggcctggatcaccctgctcatgcttcctgactttgaccgcaggtgggatgacaccatcctcagctccgccttggctgccaatggctgggtgttcctgttggcttatgttagtcccgagttttggctgctcacaaagcaacgaaaccccatggattatcctgttgaggatgctttctgtaaacctcaactcgtgaagaagagctatggtgtggagaacagagcctactctcaagaggaaatcactcaaggttttgaagagacaggggacacgctctatgccccctattccacacattttcagctgcagaaccagcctccccaaaaggaattctccatcccacgggcccacgcttggccgagcccttacaaagactatgaagtaaagaaagagggcagctaactctgtcctgaagagtgggacaaatgcagccgggcggcagatctagcgggagctcaaagggatgtgggcgaaatcttgagtcttctgagaaaactgtacaagacactacgggaacagtttgcctccctcccagcctcaaccacaattcttccatgctggggctgatgtgggctagtaagactccagttcttagaggcgctgtagtatttttttttttttgtctcatcctttggatacttcttttaagtgggagtctcaggcaactcaagtttagacccttactctttttgtttgttttttgaaacaggatcttgctctgtcacccaggcttgagtgcagtggtgcgatcacagcccagtgcagcctcgaccacctgtgctcaagcaatcctcccatctccatctcccaaagtgctgggatgacaggcgtgagccacagctcccagcctaggcccttaatcttgctgttattttccatggactaaaggtctggtcatctgagctcacgctggctcacacagctctaggggcctgctcctctaactcacagtgggttttgtgaggctctgtggcccagagcagacctgcatatctgagcaaaaatagcaaaagcctctctcagcccactggcctgaatctacactggaagccaacttgctggcacccccgctccccaacccttcttgcctgggtaggagaggctaaagatcaccctaaatttactcatctctctagtgctgcctcacattgggcctcagcagctccccagcaccaattcacaggtcacccctctcttcttgcactgtccccaaacttgctgtcaattccgagatctaatctccccctacgctctgccaggaattctttcagacctcactagcacaagcccggttgctccttgtcaggagaatttgtagatcattctcacttcaaattcctggggctgatacttctctcatcttgcaccccaacctctgtaaatagatttaccgcatttacggctgcattctgtaagtgggcatggtctcctaatggaggagtgttcattgtataataagttattcacctgagtatgcaataaagatgtggtggccactctttcatggtggtggcagcagttaccagtaatgagcattagactctgggggatagaacacgggctgccctgagagcttcatgttggagctgaagttcaaggttcacttcctttgggtttgtacttgacccttcttcatgtgtctctcccgttccctctaaaacaagtgtgtttcccctcatttttgaggctgtcaatggtgtgagagccaggatcatcacggggcctgaggttttactccagaaaagcagaggagtggcaaccttggcttggggtttggcagcccaggaaaggcagggaggagagctcaaagccggtttcatgtttcacccaaggtctaattgtgggagaggacaaatccagatcccctgtttgacagaattagttcacaaatgtctcttggcaaaaacatgtgacacctaaccatgataattgacttaatccaagaaagagctctgtagggcagagcaataggaaatctctctttcgttatggaaaaaaaataatccctctacatagaaactgagtgacatgtaaaaatgtgtagctaagtcagggagttacttcctaagagcctgacgctctgcttttcatcaaaaggaaaaaccagcgtgaggcagaggcgagggaggtggaggtgagtggatgatgtgctgagttagggatgtttatatgccgcaaaggtttggttggtaggcttcgcgctaagattagcctggctttgtactgaaaagggggaaggacacatagtgacacagatccttctggtctttcccaggaggtgtgacctaatgaggtttgttgtgagaata

SEQ ID NO: 784 - DNA, 2456 bp, Homo sapiens
ataacagcatgaagtgccgtggaactggaataggcgtgtcctctccctcgaccctccccctccttgtccctctgctcacccctcgctcgttccctccctccggcgagggccgcctttataacaactgctcagagtgcgagggcgggatagctgtccaaggtctcccccagcactgaggagctcgcctgctgccctcttgcgcgcgggaagcagcaccaagttcacggccaacgccttggcactagggtccagaatggctacaacagtccctgatggttgccgcaatggcctgaaatccaagtactacagactttgtgataaggctgaagcttggggcatcgtcctagaaacggtggccacagccggggttgtgacctcggtggccttcatgctcactctcccgatcctcgtctgcaaggtgcaggactccaacaggcgaaaaatgctgcctactcagtttctcttcctcctgggtgtgttgggcatctttggcctcaccttcgccttcatcatcggactggacgggagcacagggcccacacgcttcttcctctttgggatcctcttttccatctgcttctcctgcctgctggctcatgctgtcagtctgaccaagctcgtccgggggaggaagcccctttccctgttggtgattctgggtctggccgtgggcttcagcctagtccaggatgttatcgctattgaatatattgtcctgaccatgaataggaccaacgtcaatgtcttttctgagctttccgctcctcgtcgcaatgaagactttgtcctcctgctcacctacgtcctcttcttgatggcgctgaccttcctcatgtcctccttcaccttctgtggttccttcacgggctggaagagacatggggcccacatctacctcacgatgctcctctccattgccatctgggtggcctggatcaccctgctcatgcttcctgactttgaccgcaggtgggatgacaccatcctcagctccgccttggctgccaatggctgggtgttcctgttggcttatgttagtcccgagttttggctgctcacaaagcaacgaaaccccatggattatcctgttgaggatgctttctgtaaacctcaactcgtgaagaagagctatggtgtggagaacagagcctactctcaagaggaaatcactcaaggttttgaagagacaggggacacgctctatgccccctattccacacattttcagctgcagaaccagcctccccaaaaggaattctccatcccacgggcccacgcttggccgagcccttacaaagactatgaagtaaagaaagagggcagctaactctgtcctgaagagtgggacaaatgcagccgggcggcagatctagcgggagctcaaagggatgtgggcgaaatcttgagtcttctgagaaaactgtacaagacactacgggaacagtttgcctccctcccagcctcaaccacaattcttccatgctggggctgatgtgggctagtaagactccagttcttagaggcgctgtagtatttttttttttttgtctcatcctttggatacttcttttaagtgggagtctcaggcaactcaagtttagacccttactctttttgtttgttttttgaaacaggatcttgctctgtcacccaggcttgagtgcagtggtgcgatcacagcccagtgcagcctcgaccacctgtgctcaagcaatcctcccatctccatctcccaaagtgctgggatgacaggcgtgagccacagctcccagcctaggcccttaatcttgctgttattttccatggactaaaggtctggtcatctgagctcacgctggctcacacagctctaggggcctgctcctctaactcacagtgggttttgtgaggctctgtggcccagagcagacctgcatatctgagcaaaaatagcaaaagcctctctcagcccactggcctgaatctacactggaagccaacttgctggcacccccgctccccaacccttcttgcctgggtaggagaggctaaagatcaccctaaatttactcatctctctagtgctgcctcacattgggcctcagcagctccccagcaccaattcacaggtcacccctctcttcttgcactgtccccaaacttgctgtcaattccgagatctaatctccccctacgctctgccaggaattctttcagacctcactagcacaagcccggttgctccttgtcaggagaatttgtagatcattctcacttcaaattcctggggctgatacttctctcatcttgcaccccaacctctgtaaatagatttaccgcatttacggctgcattctgtaagtgggcatggtctcctaatggaggagtgttcattgtataataagttattcacctgagtatgcaataaagatgtggtggccactctttcatggtggtggcagcaaaaaaaaaaaaaa

SEQ ID NO: 785 - DNA, 5947 bp, Homo sapiens
caaaggaggctctggcgggcgacggaaggaaccctaaggactctgcaatatgaataattccctagagaacaccatctcctttgaagagtacatccgagtaaaggcacggtctgtcccgcaacacaggatgaaggaatttctggactcactggcctctaaggggccagaagcccttcaggagttccagcagacagccaccactaccatggtgtaccaacagggtgggaactgcatatacacagacagcactgaagtggctgggtctttgcttgaacttgcctgtccagtcaccaccagtgttcagccacaaacccagcaagaacagcagatccaggttcagcagccgcagcaggttcaggtccaggtgcaggtacagcagtctccgcaacaggtctcggctcagctctccccacaactcaccgttcaccagcctactgagcaacccatccaggtccaggtgcagatccaaggccaggcaccacagtcagcagccccctccattcagaccccgtctctgcagagtcccagtccctcgcagctgcaagcagctcagatccaggtgcagcacgtgcaagcagcccagcagatccaggctgcagaaatcccggaggagcacatcccacatcagcaaatccaggctcagctggtggctggccagtctcttgctggtggtcagcagatccaaatccagaccgtgggtgccctttccccaccaccatcccagcagggctcaccccgggaaggggagcggcgggttggcacggccagtgtcctccaaccagtgaagaagcgcaaagtggacatgcccatcactgtgtcctacgccatctcagggcagccggtggccaccgtgctggccattccacagggccagcagcagagttatgtgtctttgaggccagacttactgacagtagacagtgcccacctgtacagtgccactgggaccattactagccctacaggagaaacctggaccatccctgtttattctgcccagccccggggggaccctcagcagcagagcattacccacattgccattccccaggaagcctacaacgcagttcacgtcagtggctcacccacagccctggcagctgttaagctggaggatgacaaggagaagatggtgggcaccacatctgtagtgaaaaactcccatgaagaggtagtgcagacccttgcaaactctctctttccagcacagttcatgaatggcaacatccacattccagtggctgtgcaggctgtggcaggcacgtaccagaatacggctcaaactgtccatatatgggacccccaacagcagccgcagcagcaaactccccaggaacagacaccaccaccacagcagcagcagcagcaactccaagttacttgttcagctcaaactgtccaggttgctgaagttgaaccacagtcacagccacagccttccccagaacttctgcttccaaattctttgaagccagaagaagggcttgaagtatggaaaaactgggcccagaccaagaatgctgaactagagaaggatgctcagaacagattggcacccattgggaggcgccaactgctgcgattccaggaagatctcatctcctctgctgtggcagagttgaattatgggctctgtctaatgacacgggaagctcgaaatggagaaggtgaaccctatgacccagatgtgctctactatattttcctgtgtattcaaaagtatctttttgaaaatggaagggtagatgacattttctccgatctttattatgttcggttcacggagtggctacatgaagttctgaaggatgttcagccccgggtcactccacttggctatgtcttgcccagccacgtgactgaggagatgctatgggagtgcaagcagcttggggctcactccccctccaccttgctgaccaccctcatgttctttaataccaagtaagtgttctagaggctccactgctggcatctgtccagtgaagagtgtggaaactatccaagaggccttctgaattcctctgacatatatttgagaaactgggctactgaaagccctaaccccacttggctgcattttatttggtaaccagtgaggcaaacacccttgccagacccctaccatccatcttgatgtggttcctgcactggacactgcttgggtacttcctattgaagacagtggaccagcacatgaagctggccttctccaaggtcttgcgacagacaaagaagaacccctctaatcccaaggataaaagcacgagtatccggtacttgaaggcccttggaatacaccagactggccagaaagttacagatgacatgtatgcagaacagacggaaaatccagagaatccattgagatgtcccatcaagctctatgatttctacctcttcaaatgcccccagagtgtgaaaggccggaatgacaccttttacctgacacctgagccagtggtggcccccaacagcccaatctggtactcagtccagcctatcagcagagagcagatgggacaaatgctgacgcggatcctggtgataagagaaattcaggaggccatcgcagtggccaatgcaagcactatgcactgagatgccttggccatggcacaagagaaaccagccaggaaaaaccagacagactttcacactaaagaagaggcctccatttttttttttcttttttttattggtgtagttacgaagcctttcaggctgcttctgtttaaaatataaaagaaaactttgccccctttgcatcttcataaacctgctgcggcagactcctcagccgatggtggctctgggtttccttgagtgtcatatgtcctagaaagttgctggctgactcttttttgtctggggcctggggaaagggcttggactgtgaaaagaaatgtggcccctttccatcttcaagagagatggaattaatgatggatggaccctggagggaatctccccagccgacttccactgggctgacagactttgctgaccacaggggaacgatgttcttttctttcttcatgatcagacataaacttagcatcttaatggaagaaaaatgaggggaacttcaattatgatttattaaagacaatttctattacaccctcctttatgacaagtgacattttagatgtaaaagtaaaaactttaccatgccttttttttttttgttggcctaacattgaggccttaaaacctgaggctcctgtgcctgatggaattcttgtaacatacacttgtgtatcatataaagataccactctgtttctcttatgtattcttactctagttgtttattaagaatgacaagcacgtcttttcaacatgttagtgaacaacgtctctttattttggggaggagcccggcgggacagtagaagtaaacccttgcctgttaattgaactggccgaggtcctgcggggagtgtggggtgggacgtgaagtggcagctcctcagtgacaaggccactatgtgctatacgcatgcgctgtttcttcagcgccagctccgcccccgccgcagcgaggcgggtaggttccgcccgcgcgcactacgccctgacgtcagcgtcgcgcgcagcgcagtgacgaaatcggctggtttatattggcgcggcccagacggcagaggtctctgcggcgcggtcctcggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcgcagcaagaagggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggactcttcccagggaaattccatcttccagatcaatatgatcaagtacatcaaagacaaataccctaatctccaagtcattggaggcaatgtggtcactgctgcccaggccaagaacctcattgatgcaggtgtggatgccctgcgggtgggcatgggaagtggctccatctgcattacgcaggaagtgctggcctgtgggcggccccaagcaacagcagtgtacaaggtgtcagagtatgcacggcgctttggtgttccggtcattgctgatggaggaatccaaaatgtgggtcatattgcgaaagccttggcccttggggcctccacagtcatgatgggctctctcctggctgccaccactgaggcccctggtgaatacttcttttccgatgggatccggctaaagaaatatcgcggtatgggttctctcgatgccatggacaagcacctcagcagccagaacagatatttcagtgaagctgacaaaatcaaagtggcccagggagtgtctggtgctgtgcaggacaaagggtcaatccacaaatttgtcccttacctgattgctggcatccaacactcatgccaggacattggtgccaagagcttgacccaagtccgagccatgatgtactctggggagcttaagtttgagaagagaacgtcctcagcccaggtggaaggtggcgtccatagcctccattcgtatgagaagcggcttttctgaaaagggatccagcacacctcctcggtttttttttcaataaaagtttagaaagaaaaaagtgatgcctgatctttcaacagacaggtggggctctgtagctgccactaccacagatgcacacaaaaacagcaccctcatttccagggggagcctcaggccccgagataaatgtgctccatggacctggaagcgggtagttccaggtccaaaaagttcctcctgaggctgctcacaaaacagctgactatagctatagctatggctcttggggtttcagtctcacactgagcatctgactctggctcccaaggggtcaaagaacaagccctgggactggcatacacagggcatcctgctagcccatagcttggccatataggaccaggtcaacacacatatatattccctaacttgaatctctctcggccaggcacattggctcacgtctgtaatcccagcactttgggaggcaggtggatcacttgaggtcaggagttcgagaccatcctggccaacatggtgaaccctttctctactaaaaatacaaaaattagctgggcgtggtgatgcatacctctagtcccagctactcaggaggctgaggcaggagaatcactgaaacccaggaggcggaggttgcagtgagctgagactgcgccactgcactccaccctggcgaaagagcaagactcatctccag

SEQ ID NO: 786 - DNA, 3539 bp, Homo sapiens
cccccagagtgtgaaaggccggaatgacaccttttacctgacacctgagccagtggtggcccccaacagcccaatctggtactcagtccagcctatcagcagagagcagatgggacaaatgctgacgcggatcctggtgataagagaaattcaggaggccatcgcagtggccaatgcaagcactatgcactgagatgccttggccatggcacaagagaaaccagccaggaaaaaccagacagactttcacactaaagaagaggcctccatttttttttttcttttttttattggtgtagttacgaagcctttcaggctgcttctgtttaaaatataaaagaaaactttgccccctttgcatcttcataaacctgctgcggcagactcctcagccgatggtggctctgggtttccttgagtgtcatatgtcctagaaagttgctggctgactcttttttgtctggggcctggggaaagggcttggactgtgaaaagaaatgtggcccctttccatcttcaagagagatggaattaatgatggatggaccctggagggaatctccccagccgacttccactgggctgacagactttgctgaccacaggggaacgatgttcttttctttcttcatgatcagacataaacttagcatcttaatggaagaaaaatgaggggaacttcaattatgatttattaaagacaatttctattacaccctcctttatgacaagtgacattttagatgtaaaagtaaaaactttaccatgccttttttttttttgttggcctaacattgaggccttaaaacctgaggctcctgtgcctgatggaattcttgtaacatacacttgtgtatcatataaagataccactctgtttctcttatgtattcttactctagttgtttattaagaatgacaagcacgtcttttcaacatgttagtgaacaacgtctctttattttggggaggagcccggcgggacagtagaagtaaacccttgcctgttaattgaactggccgaggtcctgcggggagtgtggggtgggacgtgaagtggcagctcctcagtgacaaggccactatgtgctatacgcatgcgctgtttcttcagcgccagctccgcccccgccgcagcgaggcgggtaggttccgcccgcgcgcactacgccctgacgtcagcgtcgcgcgcagcgcagtgacgaaatcggctggtttatattggcgcggcccagacggcagaggtctctgcggcgcggtcctcggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcgcagcaagaagggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggactcttcccagggaaattccatcttccagatcaatatgatcaagtacatcaaagacaaataccctaatctccaagtcattggaggcaatgtggtcactgctgcccaggccaagaacctcattgatgcaggtgtggatgccctgcgggtgggcatgggaagtggctccatctgcattacgcaggaagtgctggcctgtgggcggccccaagcaacagcagtgtacaaggtgtcagagtatgcacggcgctttggtgttccggtcattgctgatggaggaatccaaaatgtgggtcatattgcgaaagccttggcccttggggcctccacagtcatgatgggctctctcctggctgccaccactgaggcccctggtgaatacttcttttccgatgggatccggctaaagaaatatcgcggtatgggttctctcgatgccatggacaagcacctcagcagccagaacagatatttcagtgaagctgacaaaatcaaagtggcccagggagtgtctggtgctgtgcaggacaaagggtcaatccacaaatttgtcccttacctgattgctggcatccaacactcatgccaggacattggtgccaagagcttgacccaagtccgagccatgatgtactctggggagcttaagtttgagaagagaacgtcctcagcccaggtggaaggtggcgtccatagcctccattcgtatgagaagcggcttttctgaaaagggatccagcacacctcctcggtttttttttcaataaaagtttagaaagaaaaaagtgatgcctgatctttcaacagacaggtggggctctgtagctgccactaccacagatgcacacaaaaacagcaccctcatttccagggggagcctcaggccccgagataaatgtgctccatggacctggaagcgggtagttccaggtccaaaaagttcctcctgaggctgctcacaaaacagctgactatagctatagctatggctcttggggtttcagtctcacactgagcatctgactctggctcccaaggggtcaaagaacaagccctgggactggcatacacagggcatcctgctagcccatagcttggccatataggaccaggtcaacacacatatatattccctaacttgaatctctctcggccaggcacattggctcacgtctgtaatcccagcactttgggaggcaggtggatcacttgaggtcaggagttcgagaccatcctggccaacatggtgaaccctttctctactaaaaatacaaaaattagctgggcgtggtgatgcatacctctagtcccagctactcaggaggctgaggcaggagaatcactgaaacccaggaggcggaggttgcagtgagctgagactgcgccactgcactccaccctggcgaaagagcaagactcatctccag

SEQ ID NO: 787 - DNA, 1646 bp, Homo sapiens
cggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcgcagcaagaagggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggactcttcccagggaaattccatcttccagatcaatatgatcaagtacatcaaagacaaataccctaatctccaagtcattggaggcaatgtggtcactgctgcccaggccaagaacctcattgatgcaggtgtggatgccctgcgggtgggcatgggaagtggctccatctgcattacgcaggaagtgctggcctgtgggcggccccaagcaacagcagtgtacaaggtgtcagagtatgcacggcgctttggtgttccggtcattgctgatggaggaatccaaaatgtgggtcatattgcgaaagccttggcccttggggcctccacagtcatgatgggctctctcctggctgccaccactgaggcccctggtgaatacttcttttccgatgggatccggctaaagaaatatcgcggtatgggttctctcgatgccatggacaagcacctcagcagccagaacagatatttcagtgaagctgacaaaatcaaagtggcccagggagtgtctggtgctgtgcaggacaaagggtcaatccacaaatttgtcccttacctgattgctggcatccaacactcatgccaggacattggtgccaagagcttgacccaagtccgagccatgatgtactctggggagcttaagtttgagaagagaacgtcctcagcccaggtggaaggtggcgtccatagcctccattcgtatgagaagcggcttttctgaaaagggatccagcacacctcctcggtttttttttcaataaaagtttagaaagaaaaaaaaaaaaaaaaaa

SEQ ID NO: 788 - DNA, 5726 bp, Homo sapiens
caaaggaggctctggcgggcgacggaaggaaccctaaggactctgcaatatgaataattccctagagaacaccatctcctttgaagagtacatccgagtaaaggcacggtctgtcccgcaacacaggatgaaggaatttctggactcactggcctctaaggggccagaagcccttcaggagttccagcagacagccaccactaccatggtgtaccaacagggtgggaactgcatatacacagacagcactgaagtggctgggtctttgcttgaacttgcctgtccagtcaccaccagtgttcagccacaaacccagcaagaacagcagatccaggttcagcagccgcagcaggttcaggtccaggtgcaggtacagcagtctccgcaacaggtctcggctcagctctccccacaactcaccgttcaccagcctactgagcaacccatccaggtccaggtgcagatccaaggccaggcaccacagtcagcagccccctccattcagaccccgtctctgcagagtcccagtccctcgcagctgcaagcagctcagatccaggtgcagcacgtgcaagcagcccagcagatccaggctgcagaaatcccggaggagcacatcccacatcagcaaatccaggctcagctggtggctggccagtctcttgctggtggtcagcagatccaaatccagaccgtgggtgccctttccccaccaccatcccagcagggctcaccccgggaaggggagcggcgggttggcacggccagtgtcctccaaccagtgaagaagcgcaaagtggacatgcccatcactgtgtcctacgccatctcagggcagccggtggccaccgtgctggccattccacagggccagcagcagagttatgtgtctttgaggccagacttactgacagtagacagtgcccacctgtacagtgccactgggaccattactagccctacaggagaaacctggaccatccctgtttattctgcccagccccggggggaccctcagcagcagagcattacccacattgccattccccaggaagcctacaacgcagttcacgtcagtggctcacccacagccctggcagctgttaagctggaggatgacaaggagaagatggtgggcaccacatctgtagtgaaaaactcccatgaagaggtagtgcagacccttgcaaactctctctttccagcacagttcatgaatggcaacatccacattccagtggctgtgcaggctgtggcaggcacgtaccagaatacggctcaaactgtccatatatgggacccccaacagcagccgcagcagcaaactccccaggaacagacaccaccaccacagcagcagcagcagcaactccaagttacttgttcagctcaaactgtccaggttgctgaagttgaaccacagtcacagccacagccttccccagaacttctgcttccaaattctttgaagccagaagaagggcttgaagtatggaaaaactgggcccagaccaagaatgctgaactagagaaggatgctcagaacagattggcacccattgggaggcgccaactgctgcgattccaggaagatctcatctcctctgctgtggcagagttgaattatgggctctgtctaatgacacgggaagctcgaaatggagaaggtgaaccctatgacccagatgtgctctactatattttcctgtgtattcaaaagtatctttttgaaaatggaagggtagatgacattttctccgatctttattatgttcggttcacggagtggctacatgaagttctgaaggatgttcagccccgggtcactccacttggctatgtcttgcccagccacgtgactgaggagatgctatgggagtgcaagcagcttggggctcactccccctccaccttgctgaccaccctcatgttctttaataccaagtacttcctattgaagacagtggaccagcacatgaagctggccttctccaaggtcttgcgacagacaaagaagaacccctctaatcccaaggataaaagcacgagtatccggtacttgaaggcccttggaatacaccagactggccagaaagttacagatgacatgtatgcagaacagacggaaaatccagagaatccattgagatgtcccatcaagctctatgatttctacctcttcaaatgcccccagagtgtgaaaggccggaatgacaccttttacctgacacctgagccagtggtggcccccaacagcccaatctggtactcagtccagcctatcagcagagagcagatgggacaaatgctgacgcggatcctggtgataagagaaattcaggaggccatcgcagtggccaatgcaagcactatgcactgagatgccttggccatggcacaagagaaaccagccaggaaaaaccagacagactttcacactaaagaagaggcctccatttttttttttcttttttttattggtgtagttacgaagcctttcaggctgcttctgtttaaaatataaaagaaaactttgccccctttgcatcttcataaacctgctgcggcagactcctcagccgatggtggctctgggtttccttgagtgtcatatgtcctagaaagttgctggctgactcttttttgtctggggcctggggaaagggcttggactgtgaaaagaaatgtggcccctttccatcttcaagagagatggaattaatgatggatggaccctggagggaatctccccagccgacttccactgggctgacagactttgctgaccacaggggaacgatgttcttttctttcttcatgatcagacataaacttagcatcttaatggaagaaaaatgaggggaacttcaattatgatttattaaagacaatttctattacaccctcctttatgacaagtgacattttagatgtaaaagtaaaaactttaccatgccttttttttttttgttggcctaacattgaggccttaaaacctgaggctcctgtgcctgatggaattcttgtaacatacacttgtgtatcatataaagataccactctgtttctcttatgtattcttactctagttgtttattaagaatgacaagcacgtcttttcaacatgttagtgaacaacgtctctttattttggggaggagcccggcgggacagtagaagtaaacccttgcctgttaattgaactggccgaggtcctgcggggagtgtggggtgggacgtgaagtggcagctcctcagtgacaaggccactatgtgctatacgcatgcgctgtttcttcagcgccagctccgcccccgccgcagcgaggcgggtaggttccgcccgcgcgcactacgccctgacgtcagcgtcgcgcgcagcgcagtgacgaaatcggctggtttatattggcgcggcccagacggcagaggtctctgcggcgcggtcctcggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcgcagcaagaagggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggactcttcccagggaaattccatcttccagatcaatatgatcaagtacatcaaagacaaataccctaatctccaagtcattggaggcaatgtggtcactgctgcccaggccaagaacctcattgatgcaggtgtggatgccctgcgggtgggcatgggaagtggctccatctgcattacgcaggaagtgctggcctgtgggcggccccaagcaacagcagtgtacaaggtgtcagagtatgcacggcgctttggtgttccggtcattgctgatggaggaatccaaaatgtgggtcatattgcgaaagccttggcccttggggcctccacagtcatgatgggctctctcctggctgccaccactgaggcccctggtgaatacttcttttccgatgggatccggctaaagaaatatcgcggtatgggttctctcgatgccatggacaagcacctcagcagccagaacagatatttcagtgaagctgacaaaatcaaagtggcccagggagtgtctggtgctgtgcaggacaaagggtcaatccacaaatttgtcccttacctgattgctggcatccaacactcatgccaggacattggtgccaagagcttgacccaagtccgagccatgatgtactctggggagcttaagtttgagaagagaacgtcctcagcccaggtggaaggtggcgtccatagcctccattcgtatgagaagcggcttttctgaaaagggatccagcacacctcctcggtttttttttcaataaaagtttagaaagaaaaaagtgatgcctgatctttcaacagacaggtggggctctgtagctgccactaccacagatgcacacaaaaacagcaccctcatttccagggggagcctcaggccccgagataaatgtgctccatggacctggaagcgggtagttccaggtccaaaaagttcctcctgaggctgctcacaaaacagctgactatagctatagctatggctcttggggtttcagtctcacactgagcatctgactctggctcccaaggggtcaaagaacaagccctgggactggcatacacagggcatcctgctagcccatagcttggccatataggaccaggtcaacacacatatatattccctaacttgaatctctctcggccaggcacattggctcacgtctgtaatcccagcactttgggaggcaggtggatcacttgaggtcaggagttcgagaccatcctggccaacatggtgaaccctttctctactaaaaatacaaaaattagctgggcgtggtgatgcatacctctagtcccagctactcaggaggctgaggcaggagaatcactgaaacccaggaggcggaggttgcagtgagctgagactgcgccactgcactccaccctggcgaaagagcaagactcatctccag

SEQ ID NO: 789 - DNA, 5586 bp, Homo sapiens
caaaggaggctctggcgggcgacggaaggaaccctaaggactctgcaatatgaataattccctagagaacaccatctcctttgaagagtacatccgagtaaaggcacggtctgtcccgcaacacaggatgaaggaatttctggactcactggcctctaaggggccagaagcccttcaggagttccagcagacagccaccactaccatggtgtaccaacagggtgggaactgcatatacacagacagcactgaagtggctgggtctttgcttgaacttgcctgtccagtcaccaccagtgttcagccacaaacccagcaagaacagcagatccaggttcagcagccgcagcaggttcaggtccaggtgcaggtacagcagtctccgcaacaggtctcggctcagctctccccacaactcaccgttcaccagcctactgagcaacccatccaggtccaggtgcagatccaaggccaggcaccacagtcagcagccccctccattcagaccccgtctctgcagagtcccagtccctcgcagctgcaagcagctcagatccaggtgcagcacgtgcaagcagcccagcagatccaggctgcagaaatcccggaggagcacatcccacatcagcaaatccaggctcagctggtggctggccagtctcttgctggtggtcagcagatccaaatccagaccgtgggtgccctttccccaccaccatcccagcagggctcaccccgggaaggggagcggcgggttggcacggccagtgtcctccaaccagtgaagaagcgcaaagtggacatgcccatcactgtgtcctacgccatctcagggcagccggtggccaccgtgctggccattccacagggccagcagcagagttatgtgtctttgaggccagacttactgacagtagacagtgcccacctgtacagtgccactgggaccattactagccctacaggagaaacctggaccatccctgtttattctgcccagccccggggggaccctcagcagcagagcattacccacattgccattccccaggaagcctacaacgcagttcacgtcagtggctcacccacagccctggcagctgttaagctggaggatgacaaggagaagatggtgggcaccacatctgtagtgaaaaactcccatgaagaggtagtgcagacccttgcaaactctctctttccagcacagttcatgaatggcaacatccacattccagtggctgtgcaggctgtggcaggcacgtaccagaatacggctcaaactgtccatatatgggacccccaacagcagccgcagcagcaaactccccaggaacagacaccaccaccacagcagcagcagcagcaactccaagttacttgttcagctcaaactgtccaggttgctgaagttgaaccacagtcacagccacagccttccccagaacttctgcttccaaattctttgaagccagaagaagggcttgaagtatggaaaaactgggcccagaccaagaatgctgaactagagaaggatgctcagaacagattggcacccattgggaggcgccaactgctgcgattccaggaagatctcatctcctctgctgtggcagagttgaattatgggctctgtctaatgacacgggaagctcgaaatggagaaggtgaaccctatgacccagatgtgctctactatattttcctgtgtattcaaaagtatctttttgaaaatggaagggtagatgacattttctccgatctttattatgttcggttcacggagtggctacatgaagttctgaaggatgttcagccccgggtcactccacttggctatgtcttgcccagccacgtgactgaggagatgctatgggagtgcaagcagcttggggctcactccccctccaccttgctgaccaccctcatgttctttaataccaagtacttcctattgaagacagtggaccagcacatgaagctggccttctccaaggtcttgcgacagacaaagaagaacccctctaatcccaaggataaaagcacgagtatccggtacttgaaggcccttggaatacaccagactggccagaaagttacagatgacatgtatgcagaacagacggaaaatccagagaatccattgagatgtcccatcaagctctatgatttctacctcttcaaatgcccccagagtgtgaaaggccggaatgacaccttttacctgacacctgagccagtggtggcccccaacagcccaatctggtactcagtccagcctatcagcagagagcagatgggacaaatgctgacgcggatcctggtgataagagaaattcaggaggccatcgcagtggccaatgcaagcactatgcactgagatgccttggccatggcacaagagaaaccagccaggaaaaaccagacagactttcacactaaagaagaggcctccatttttttttttcttttttttattggtgtagttacgaagcctttcaggctgcttctgtttaaaatataaaagaaaactttgccccctttgcatcttcataaacctgctgcggcagactcctcagccgatggtggctctgggtttccttgagtgtcatatgtcctagaaagttgctggctgactcttttttgtctggggcctggggaaagggcttggactgtgaaaagaaatgtggcccctttccatcttcaagagagatggaattaatgatggatggaccctggagggaatctccccagccgacttccactgggctgacagactttgctgaccacaggggaacgatgttcttttctttcttcatgatcagacataaacttagcatcttaatggaagaaaaatgaggggaacttcaattatgatttattaaagacaatttctattacaccctcctttatgacaagtgacattttagatgtaaaagtaaaaactttaccatgccttttttttttttgttggcctaacattgaggccttaaaacctgaggctcctgtgcctgatggaattcttgtaacatacacttgtgtatcatataaagataccactctgtttctcttatgtattcttactctagttgtttattaagaatgacaagcacgtcttttcaacatgttagtgaacaacgtctctttattttggggaggagcccggcgggacagtagaagtaaacccttgcctgttaattgaactggccgaggtcctgcggggagtgtggggtgggacgtgaagtggcagctcctcagtgacaaggccactatgtgctatacgcatgcgctgtttcttcagcgccagctccgcccccgccgcagcgaggcgggtaggttccgcccgcgcgcactacgccctgacgtcagcgtcgcgcgcagcgcagtgacgaaatcggctggtttatattggcgcggcccagacggcagaggtctctgcggcgcggtcctcggagacacgcggcggtgtcctgtgttggccatggccgactacctgattagtgggggcacgtcctacgtgccagacgacggactcacagcacagacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcgcagcaagaagggtgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggactcttcccagggaaattccatcttccagatcaatatgatcaagtacatcaaagacaaataccctaatctccaagtcattggaggcaatgtggtcactgctgcccaggccaagaacctcattgatgcaggtgtggatgccctgcgggtgggcatgggaagtggctccatctgcattacgcaggaagtgctggcctgtgggcggccccaagcaacagcagtgtacaaggtgtcagagtatgcacggcgctttggtgttccggtcattgctgatggaggaatccaaaatgtgggtcatattgcgaaagccttggcccttggggcctccacagtcatgatgggctctctcctggctgccaccactgaggcccctggtgaatacttcttttccgatgggatccggctaaagaaatatcgcggtatgggttctctcgatgccatggacaagcacctcagcagccagaacagatatttcagtgaagctgacaaaatcaaagtggcccagggagtgtctggtgctgtgcaggacaaagggtcaatccacaaatttgtcccttacctgattgctggcatccaacactcatgccaggacattggtgccaagagcttgacccaaagccatgatgtactctggggagcttaagtttgagaagagaacgtcctcagcccaggtggaaggtggcgtccatagcctccattcgtatgagaagcggcttttctgaaaagggatccagcacacctcctcggtttttttttcaataaaagtttagaaagaaaaaagtgatgcctgatctttcaacagacaggtggggctctgtagctgccactaccacagatgcacacaaaaacagcaccctcatttccagggggagcctcaggccccgagataaatgtgctccatggacctggaagcgggtagttccaggtccaaaaagttcctcctgaggctgctcacaaaacagctgactatagctatagctatggctcttggggtttcagtctcacactgagcatctgactctggctcccaaggggtcaaagaacaagccctgggactggcatacacagggcatcctgctagcccatagcttggccatataggaccaggtcaacacacatatatattccctaacttgaatctctctcggccaggcacattggctcacgtctgtaatcccagcactttgggaggcaggtggatcacttgaggtcaggagttcgagaccatcctggccaacatggtgaaccctttctctactaaaaatacaaaaattagctgggcgtggtgatgcatacctctagtcccagctactcaggaggctgaggcaggagaatcactgaaacccaggaggcggaggttgcagtgagctgagactgcgccactgcactccaccctggcgaaagagcaagactcatctccag

SEQ ID NO: 790 - DNA, 5727 bp, Homo sapiens
caaaggaggctctggcgggcgacggaaggaaccctaaggactctgcaatatgaataattccctagagaacaccatctcctttgaagagtacatccgagtaaaggcacggtctgtcccgcaacacaggatgaaggaatttctggactcactggcctctaaggggccagaagcccttcaggagttccagcagacagccaccactaccatggtgtaccaacagggtgggaactgcatatacacagacagcactgaagtggctgggtctttgcttgaacttgcctgtccagtcaccaccagtgttcagccacaaacccagcaagaacagcagatccaggttcagcagccgcagcaggttcaggtccaggtgcaggtacagcagtctccgcaacaggtctcggctcagctctccccacaactcaccgttcaccagcctactgagcaacccatccaggtccaggtgcagatccaaggccaggcaccacagtcagcagccccctccattcagaccccgtctctgcagagtcccagtccctcgcagctgcaagcagctcagatccaggtgcagcacgtgcaagcagcccagcagatccaggctgcagaaatcccggaggagcacatcccacatcagcaaatccaggctcagctggtggctggccagtctcttgctggtggtcagcagatccaaatccagaccgtgggtgccctttccccaccaccatcccagcagggctcaccccgggaaggggagcggcgggttggcacggccagtgtcctccaaccagtgaagaagcgcaaagtggacatgcccatcactgtgtcctacgccatctcagggcagccggtggccaccgtgctggccattccacagggccagcagcagagttatgtgtctttgaggccagacttactgacagtagacagtgcccacctgtacagtgccactgggaccattactagccctacaggagaaacctggaccatccctgtttattctgcccagccccggggggaccctcagcagcagagcattacccacattgccattccccaggaagcctacaacgcagttcacgtcagtggctcacccacagccctggcagctgttaagctggaggatgacaaggagaagatggtgggcaccacatctgtagtgaaaaactcccatgaagaggtagtgcagacccttgcaaactctctctttccagcacagttcatgaatggcaacatccacattccagtggctgtgcaggctgtggcaggcacgtaccagaatacggctcaaactgtccatatatgggacccccaacagcagccgcagcagcaaactccccaggaacagacaccaccaccacagcagcagcagcagcaactccaagttacttgttcagctcaaactgtccaggttgctgaagttgaaccacagtcacagccacagccttccccagaacttctgcttccaaattctttgaagccagaagaagggcttgaagtatggaaaaactgggcccagaccaagaatgctgaactagagaaggatgctcagaacagattggcacccattgggaggcgccaactgctgcgattccaggaagatctcatctcctctgctgtggcagagttgaattatgggctctgtctaatgacacgggaagctcgaaatggagaaggtgaaccctatgacccagatgtgctctactatattttcctgtgtattcaaaagtatctttttgaaaatggaagggtagatgacattttctccgatctttattatgttcggttcacggagtggctacatgaagttctgaaggatgttcagccccgggtcactccacttggctatgtcttgcccagccacgtgactgaggagatgctatgggagtgcaagcagcttggggctcactccccctccaccttgctgaccaccctcatgttctttaataccaagtacttcctattgaagacagtggaccagcacatgaagctggccttctccaaggtcttgcgacagacaaagaagaacccctctaatcccaaggataaaagcacgagtatccggtacttgaaggcccttggaatacaccagactggccagaaagttacagatgacatgtatgcagaacagacggaaaatccagagaatccattgagatgtcccatcaagctctatgatttctacctcttcaaatgcccccagagtgtgaaaggccggaatgacaccttttacctgacacctgagccagtggtggcccccaacagcccaatctggtactcagtccagcctatcagcagagagcagatgggacaaatgctgacgcggatcctggtgataagagaaattcaggaggccatcgcagtggccaatgcaagcactatgcactgagatgccttggccatggcacaagagaaaccagccaggaaaaaccagacagactttcacactaaagaagaggcctccatttttttttttcttttttttattggtgtagttacgaagcctttcaggctgcttctgtttaaaatataaaagaaaactttgccccctttgcatcttcataaacctgctgcggcagactcctcagccgatggtggctctgggtttccttgagtgtcatatgtcctagaaagttgctggctgactcttttttgtctggggcctggggaaagggcttggactgtgaaaagaaatgtggcccctttccatcttcaagagagatggaattaatgatggatggaccctggagggaatctccccagccgacttccactgggctgacagactttgctgaccacaggggaacgatgttcttttctttcttcatgatcagacataaacttagcatcttaatggaagaaaaatgaggggaacttcaattatgatttattaaagacaatttctattacaccctcctttatgacaagtgacattttagatgtaaaagtaaaaactttaccatgccttttttttttttgttggcctaacattgaggccttaaaacctgaggctcctgtgcctgatggaattcttgtaacatacacttgtgtatcatataaagataccactctgtttctcttatgtattcttactctagttgtttattaagaatgacaagcacgtcttttcaacatgttagtgaacaacgtctctttattttggggaggagcccggcgggacagtagaagtaaacccttgcctgttaattgaactggccgaggtcctgcggggagtgtggggtgggacgtgaagtggcagctcctcagtgacaaggccactatgtgctatacgcatgcgctgtttcttcagcgccagctccgcccccgccgcagcgaggcgggtaggttccgcccgcgcgcactacgccctgacgtcagcgtcgcgcgcagcgcagtgacgaaatcggctggtttatattggcgcggcccagacggcagaggtctctgcggcgcggtcctcggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcgcagcaagaagggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggactcttcccagggaaattccatcttccagatcaatatgatcaagtacatcaaagacaaataccctaatctccaagtcattggaggcaatgtggtcactgctgcccaggccaagaacctcattgatgcaggtgtggatgccctgcgggtgggcatgggaagtggctccatctgcattacgcaggaagtgctggcctgtgggcggccccaagcaacagcagtgtacaaggtgtcagagtatgcacggcgctttggtgttccggtcattgctgatggaggaatccaaaatgtgggtcatattgcgaaagccttggcccttggggctgtccgcagtcatgatgggctctctcctggctgccaccactgaggcccctggtgaatacttcttttccgatgggatccggctaaagaaatatcgcggtatgggttctctcgatgccatggacaagcacctcagcagccagaacagatatttcagtgaagctgacaaaatcaaagtggcccagggagtgtctggtgctgtgcaggacaaagggtcaatccacaaatttgtcccttacctgattgctggcatccaacactcatgccaggacattggtgccaagagcttgacccaagtccgagccatgatgtactctggggagcttaagtttgagaagagaacgtcctcagcccaggtggaaggtggcgtccatagcctccattcgtatgagaagcggcttttctgaaaagggatccagcacacctcctcggtttttttttcaataaaagtttagaaagaaaaaagtgatgcctgatctttcaacagacaggtggggctctgtagctgccactaccacagatgcacacaaaaacagcaccctcatttccagggggagcctcaggccccgagataaatgtgctccatggacctggaagcgggtagttccaggtccaaaaagttcctcctgaggctgctcacaaaacagctgactatagctatagctatggctcttggggtttcagtctcacactgagcatctgactctggctcccaaggggtcaaagaacaagccctgggactggcatacacagggcatcctgctagcccatagcttggccatataggaccaggtcaacacacatatatattccctaacttgaatctctctcggccaggcacattggctcacgtctgtaatcccagcactttgggaggcaggtggatcacttgaggtcaggagttcgagaccatcctggccaacatggtgaaccctttctctactaaaaatacaaaaattagctgggcgtggtgatgcatacctctagtcccagctactcaggaggctgaggcaggagaatcactgaaacccaggaggcggaggttgcagtgagctgagactgcgccactgcactccaccctggcgaaagagcaagactcatctccag

SEQ ID NO: 791 - DNA, 4978 bp, Homo sapiens
caaaggaggctctggcgggcgacggaaggaaccctaaggactctgcaatatgaataattccctagagaacaccatctcctttgaagagtacatccgagtaaaggcacggtctgtcccgcaacacaggatgaaggaatttctggactcactggcctctaaggggccagaagcccttcaggagttccagcagacagccaccactaccatggtgtaccaacagggtgggaactgcatatacacagacagcactgaagtggctgggtctttgcttgaacttgcctgtccagtcaccaccagtgttcagccacaaacccagcaagaacagcagatccaggttcagcagccgcagcaggttcaggtccaggtgcaggtacagcagtctccgcaacaggtctcggctcagctctccccacaactcaccgttcaccagcctactgagcaacccatccaggtccagcacagttcatgaatggcaacatccacattccagtggctgtgcaggctgtggcaggcacgtaccagaatacggctcaaactgtccatatatgggacccccaacagcagccgcagcagcaaactccccaggaacagacaccaccaccacagcagcagcagcagcaactccaagttacttgttcagctcaaactgtccaggttgctgaagttgaaccacagtcacagccacagccttccccagaacttctgcttccaaattctttgaagccagaagaagggcttgaagtatggaaaaactgggcccagaccaagaatgctgaactagagaaggatgctcagaacagattggcacccattgggaggcgccaactgctgcgattccaggaagatctcatctcctctgctgtggcagagttgaattatgggctctgtctaatgacacgggaagctcgaaatggagaaggtgaaccctatgacccagatgtgctctactatattttcctgtgtattcaaaagtatctttttgaaaatggaagggtagatgacattttctccgatctttattatgttcggttcacggagtggctacatgaagttctgaaggatgttcagccccgggtcactccacttggctatgtcttgcccagccacgtgactgaggagatgctatgggagtgcaagcagcttggggctcactccccctccaccttgctgaccaccctcatgttctttaataccaagtacttcctattgaagacagtggaccagcacatgaagctggccttctccaaggtcttgcgacagacaaagaagaacccctctaatcccaaggataaaagcacgagtatccggtacttgaaggcccttggaatacaccagactggccagaaagttacagatgacatgtatgcagaacagacggaaaatccagagaatccattgagatgtcccatcaagctctatgatttctacctcttcaaatgcccccagagtgtgaaaggccggaatgacaccttttacctgacacctgagccagtggtggcccccaacagcccaatctggtactcagtccagcctatcagcagagagcagatgggacaaatgctgacgcggatcctggtgataagagaaattcaggaggccatcgcagtggccaatgcaagcactatgcactgagatgccttggccatggcacaagagaaaccagccaggaaaaaccagacagactttcacactaaagaagaggcctccatttttttttttcttttttttattggtgtagttacgaagcctttcaggctgcttctgtttaaaatataaaagaaaactttgccccctttgcatcttcataaacctgctgcggcagactcctcagccgatggtggctctgggtttccttgagtgtcatatgtcctagaaagttgctggctgactcttttttgtctggggcctggggaaagggcttggactgtgaaaagaaatgtggcccctttccatcttcaagagagatggaattaatgatggatggaccctggagggaatctccccagccgacttccactgggctgacagactttgctgaccacaggggaacgatgttcttttctttcttcatgatcagacataaacttagcatcttaatggaagaaaaatgaggggaacttcaattatgatttattaaagacaatttctattacaccctcctttatgacaagtgacattttagatgtaaaagtaaaaactttaccatgccttttttttttttgttggcctaacattgaggccttaaaacctgaggctcctgtgcctgatggaattcttgtaacatacacttgtgtatcatataaagataccactctgtttctcttatgtattcttactctagttgtttattaagaatgacaagcacgtcttttcaacatgttagtgaacaacgtctctttattttggggaggagcccggcgggacagtagaagtaaacccttgcctgttaattgaactggccgaggtcctgcggggagtgtggggtgggacgtgaagtggcagctcctcagtgacaaggccactatgtgctatacgcatgcgctgtttcttcagcgccagctccgcccccgccgcagcgaggcgggtaggttccgcccgcgcgcactacgccctgacgtcagcgtcgcgcgcagcgcagtgacgaaatcggctggtttatattggcgcggcccagacggcagaggtctctgcggcgcggtcctcggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcgcagcaagaagggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggactcttcccagggaaattccatcttccagatcaatatgatcaagtacatcaaagacaaataccctaatctccaagtcattggaggcaatgtggtcactgctgcccaggccaagaacctcattgatgcaggtgtggatgccctgcgggtgggcatgggaagtggctccatctgcattacgcaggaagtgctggcctgtgggcggccccaagcaacagcagtgtacaaggtgtcagagtatgcacggcgctttggtgttccggtcattgctgatggaggaatccaaaatgtgggtcatattgcgaaagccttggcccttggggcctccacagtcatgatgggctctctcctggctgccaccactgaggcccctggtgaatacttcttttccgatgggatccggctaaagaaatatcgcggtatgggttctctcgatgccatggacaagcacctcagcagccagaacagatatttcagtgaagctgacaaaatcaaagtggcccagggagtgtctggtgctgtgcaggacaaagggtcaatccacaaatttgtcccttacctgattgctggcatccaacactcatgccaggacattggtgccaagagcttgacccaagtccgagccatgatgtactctggggagcttaagtttgagaagagaacgtcctcagcccaggtggaaggtggcgtccatagcctccattcgtatgagaagcggcttttctgaaaagggatccagcacacctcctcggtttttttttcaataaaagtttagaaagaaaaaagtgatgcctgatctttcaacagacaggtggggctctgtagctgccactaccacagatgcacacaaaaacagcaccctcatttccagggggagcctcaggccccgagataaatgtgctccatggacctggaagcgggtagttccaggtccaaaaagttcctcctgaggctgctcacaaaacagctgactatagctatagctatggctcttggggtttcagtctcacactgagcatctgactctggctcccaaggggtcaaagaacaagccctgggactggcatacacagggcatcctgctagcccatagcttggccatataggaccaggtcaacacacatatatattccctaacttgaatctctctcggccaggcacattggctcacgtctgtaatcccagcactttgggaggcaggtggatcacttgaggtcaggagttcgagaccatcctggccaacatggtgaaccctttctctactaaaaatacaaaaattagctgggcgtggtgatgcatacctctagtcccagctactcaggaggctgaggcaggagaatcactgaaacccaggaggcggaggttgcagtgagctgagactgcgccactgcactccaccctggcgaaagagcaagactcatctccag

SEQ ID NO: 792 - DNA, 4058 bp, Homo sapiens
cagcggccgggaaggggcggtgcgggaggcggggtgtggggcggtagtgtgggccctgttcctgcccgcgcggtgttccgcattctgcaagcctccggagcgcacgtcggcagtcggctccctcgttgaccgaatcaccgacctctctccccagctgtatttccaaaatgtcgctttctaacaagctgacgctggacaagctggacgttaaagggaagcgggtcgttatgagagtcgacttcaatgttcctatgaagaacaaccagataacaaacaaccagaggattaaggctgctgtcccaagcatcaaattctgcttggacaatggagccaagtcggtagtccttatgagccacctaggccggcctgatggtgtgcccatgcctgacaagtactccttagagccagttgctgtagaactcaaatctctgctgggcaaggatgttctgttcttgaaggactgtgtaggcccagaagtggagaaagcctgtgccaacccagctgctgggtctgtcatcctgctggagaacctccgctttcatgtggaggaagaagggaagggaaaagatgcttctgggaacaaggttaaagccgagccagccaaaatagaagctttccgagcttcactttccaagctaggggatgtctatgtcaatgatgcttttggcactgctcacagagcccacagctccatggtaggagtcaatctgccacagaaggctggtgggtttttgatgaagaaggagctgaactactttgcaaaggccttggagagcccagagcgacccttcctggccatcctgggcggagctaaagttgcagacaagatccagctcatcaataatatgctggacaaagtcaatgagatgattattggtggtggaatggcttttaccttccttaaggtgctcaacaacatggagattggcacttctctgtttgatgaagagggagccaagattgtcaaagacctaatgtccaaagctgagaagaatggtgtgaagattaccttgcctgttgactttgtcactgctgacaagtttgatgagaatgccaagactggccaagccactgtggcttctggcatacctgctggctggatgggcttggactgtggtcctgaaagcagcaagaagtatgctgaggctgtcactcgggctaagcagattgtgtggaatggtcctgtgggggtatttgaatgggaagcttttgcccggggaaccaaagctctcatggatgaggtggtgaaagccacttctaggggctgcatcaccatcataggtggtggagacactgccacttgctgtgccaaatggaacacggaggataaagtcagccatgtgagcactgggggtggtgccagtttggagctcctggaaggtaaagtccttcctggggtggatgctctcagcaatatttagtactttcctgccttttagttcctgtgcacagcccctaagtcaacttagcattttctgcatctccacttggcattagctaaaaccttccatgtcaagattcagctagtggccaagagatgcagtgccaggaacccttaaacagttgcacagcatctcagctcatcttcactgcaccctggatttgcatacattcttcaagatcccatttgaattttttagtgactaaaccattgtgcattctagagtgcatatatttatattttgcctgttaaaaagaaagtgagcagtgttagcttagttctcttttgatgtaggttattatgattagctttgtcactgtttcactactcagcatggaaacaagatgaaattccatttgtaggtagtgagacaaaattgatgatccattaagtaaacaataaaagtgtccattgaaaccgtgatttttttttttttcctgtcatactttgttaggaagggtgagaatagaatcttgaggaacggatcagatgtctatattgctgaatgcaagaagtggggcagcagcagtggagagatgggacaattagataaatgtccattctttatcaagggcctactttatggcagacattgtgctagtgcttttattctaacttttatttttatcagttacacatgatcataatttaaaaagtcaaggcttataacaaaaaagccccagcccattcctcccattcaagattcccactccccagaggtgaccactttcaactcttgagtttttcaggtatatacctccatgtttctaagtaatatgcttatattgttcacttcttttttttttattttttaaagaaatctatttcataccatggaggaaggctctgttccacatatatttccacttcttcattctctcggtatagttttgtcacaattatagattagatcaaaagtctacataactaatacagctgagctatgtagtatgctatgattaaatttacttatgtaacttttattgtctttggcattaacagtgtttcaaaaaattttctgtgtatacccatcagtgattcattcccaaatcttctagaagcataagtgtctcaatatattaaaacatattgaataatccttgttagagttatccctgcaggagtccttagtgctcctttatccaatttgtacttgatgccctctaggcagggtgtacagctagctgttgctctggtatttcctataaccttcttggggatttcttttacctcctgtgttagactcctgttttctggattcccccttttccctctttcttggtctactttttgtagaacacaagactctactagcttcctgagaaagggtgcctgggaggcaaaatctctaagactttgtaagtctgaaaatgtctttattcgacccttatacttgattcctagtttggctatatatagaattttagcctgagtatcactttttgagactcgaagccactgtttcattgtcactattgagaatctaaatggccattcggattctttcatcatctttataattttaccttcctatttctttcctgtccttttaatggagttttgggagagagcagaggtaaacatgatttgaaaaagccatgtctgaccagaaattctgtgctggcaagatatgtatttcacctttagggacaaagaaataaacttttggacaggaccacagagctagtaagtaacagcagggattcaagtccaggtttgtctggttccagtggctgatgcttttccaatgtgcctccgtccctgacatgatgcttctaggctatagatgcttctagactctatccctgacatgatgcttctagactattttgtttaaccctggatagaatagcaaaagaaaattttggtggttgctctaaacaaaacagaaatttgaaagctcaagttttttcttcatttgtattttagttaatactgtacccatatttgtagttaattttaaattgtaccatgtttctgcatacctctatgggtactcaggaattctagtccaatttttgtgactttttcctactgattacctttcctccaacgttttaaaaattatttcaaatggaactgaaagaagcataaactcccataaacccagcacctagactctacaattgccaacattatctatccaacaatctctgactgtaccttttaagtactttctactggactgtttccaggatcacccctcatttatttgggttgttaacctaaagaatgaatgggggaatctccagtcataaacaacttgtcaattaggcaaatatttgagttccttctatgtgcttaaagacgtgatagagggaatataagagcatttatgttctgaaggaatttttaacctaaccaaagaagatagtagataacttgtgtgcatataagctagaacagtataaggggccgggcatggtggcttacgcctgtaatcccaggactttgggaggccaaggctggtctcgaactcctggcctcaagtgatcctcccgcctcggtctcccaaagtgctgggattacaggtgtgagccattgtaccctgccaataattgtgtatatgtacgggatataatgtgatgttctgatctatgtatagataaagattaaa

SEQ ID NO: 793 - DNA, 3905 bp, Homo sapiens
cagcggccgggaaggggcggtgcgggaggcggggtgtggggcggtagtgtgggccctgttcctgcccgcgcggtgttccgcattctgcaagcctccggagcgcacgtcggcagtcggctccctcgttgaccgaatcaccgacctctctccccagctgtatttccaaaatgtcgctttctaacaagctgacgctggacaagctggacgttaaagggaagcgggtcgttatgagagtcgacttcaatgttcctatgaagaacaaccagataacaaacaaccagaggattaaggctgctgtcccaagcatcaaattctgcttggacaatggagccaagtcggtagtccttatgagccacctaggccggcctgatggtgtgcccatgcctgacaagtactccttagagccagttgctgtagaactcaaatctctgctgggcaaggatgttctgttcttgaaggactgtgtaggcccagaagtggagaaagcctgtgccaacccagctgctgggtctgtcatcctgctggagaacctccgctttcatgtggaggaagaagggaagggaaaagatgcttctgggaacaaggttaaagccgagccagccaaaatagaagctttccgagcttcactttccaagctaggggatgtctatgtcaatgatgcttttggcactgctcacagagcccacagctccatggtaggagtcaatctgccacagaaggctggtgggtttttgatgaagaaggagctgaactactttgcaaaggccttggagagcccagagcgacccttcctggccatcctgggcggagctaaagttgcagacaagatccagctcatcaataatatgctggacaaagtcaatgagatgattattggtggtggaatggcttttaccttccttaaggtgctcaacaacatggagattggcacttctctgtttgatgaagagggagccaagattgtcaaagacctaatgtccaaagctgagaagaatggtgtgaagattaccttgcctgttgactttgtcactgctgacaagtttgatgagaatgccaagactggccaagccactgtggcttctggcatacctgctggctggatgggcttggactgtggtcctgaaagcagcaagaagtatgctgaggctgtcactcgggctaagcagattgtgtggaatggtcctgtgggggtatttgaatgggaagcttttgcccggggaaccaaagctctcatggatgaggtggtgaaagccacttctaggggctgcatcaccatcataggtggtggagacactgccacttgctgtgccaaatggaacacggaggataaagtcagccatgtgagcactgggggtggtgccagtttggagctcctggaaggtaaagtccttcctggggtggatgctctcagcaatatttagtactttcctgccttttagttcctgtgcacagcccctaagtcaacttagcattttctgcatctccacttggcattagctaaaaccttccatgtcaagattcagctagtggccaagagatgcagtgccaggaacccttaaacagttgcacagcatctcagctcatcttcactgcaccctggatttgcatacattcttcaagatcccatttgaattttttagtgactaaaccattgtgcattctagagtgcatatatttatattttgcctgttaaaaagaaagtgagcagtgttagcttagttctcttttgatgtaggttattatgattagctttgtcactgtttcactactcagcatggaaacaagatgaaattccatttgtaggtagtgagacaaaattgatgatccattaagtaaacaataaaagtgtccattgaaaccgtgatttttttttttttcctgtcatactttgttaggaagggtgagaatagaatcttgaggaacggatcagatgtctatattgctgaatgcaagaagtggggcagcagcagtggagagatgggacaattagataaatgtccattctttatcaagggcctactttatggcagacattgtgctagtgcttttattctaacttttatttttatcagttacacatgatcataatttaaaaagtcaaggcttataacaaaaaagccccagcccattcctcccattcaagattcccactccccagaggtgaccactttcaactcttgagtttttcaggtatatacctccatgtttctaagtaatatgcttatattgttcacttcttttttttttattttttaaagaaatctatttcataccatggaggaaggctctgttccacatatatttccacttcttcattctctcggtatagttttgtcacaattatagattagatcaaaagtctacataactaatacagctgagctatgtagtatgctatgattaaatttacttatgtaacttttattgtctttggcattaacagtgtttcaaaaaattttctgtgtatacccatcagtgattcattcccaaatcttctagaagcataagtgtctcaatatattaaaacatattgaataatccttgttagagttatccctgcaggagtccttagtgctcctttatccaatttgtacttgatgccctctaggcagggtgtacagctagctgttgctctggtatttcctataaccttcttggggatttcttttacctcctgtgttagactcctgttttctggattcccccttttccctctttcttggtctactttttgtagaacacaagactctactagcttcctgagaaagggtgcctgggaggcaaaatctctaagactttgtaagtctgaaaatgtctttattcgacccttatacttgattcctagtttggctatatatagaattttagcctgagtatcactttttgagactcgaagccactgtttcattgtcactattgagaatctaaatggccattcggattctttcatcatctttataattttaccttcctatttctttcctgtccttttaatggagttttgggagagagcagaggtaaacatgatttgaaaaagccatgtctgaccagaaattctgtgctggcaagatatgtatttcacctttagggacaaagaaataaacttttggacaggaccacagagctagtaagtaacagcagggattcaagtccaggtttgtctggttccagtggctgatgcttttccaatgtgcctccgtccctgacatgatgcttctaggctatagatgcttctagactctatccctgacatgatgcttctagactattttgtttaaccctggatagaatagcaaaagaaaattttggtggttgctctaaacaaaacagaaatttgaaagctcaagttttttcttcatttgtattttagttaatactgtacccatatttgtagttaattttaaattgtaccatgtttctgcatacctctatgggtactcaggaattctagtccaatttttgtgactttttcctactgattacctttcctccaacgttttaaaaattatttcaaatggaactgaaagaagcataaactcccataaacccagcacctagactctacaattgccaacattatctatccaacaatctctgactgtaccttttaagtactttctactggactgtttccaggatcacccctcatttatttgggttgttaacctaaagaatgaatgggggaatctccagtcataaacaacttgtcaattaggcaaatatttgagttccttctatgtgcttaaagacgtgatagagggaatataagagcatttatgttctgaaggaatttttaacctaaccaaagaagatagtagataacttgtgtgcatataagctagaacagtataaggggccgggcatggtggcttacgcctgtaatcccaggactttgggaggccaag

SEQ ID NO: 794 - DNA, 2364 bp, Homo sapiens
cagcggccgggaaggggcggtgcgggaggcggggtgtggggcggtagtgtgggccctgttcctgcccgcgcggtgttccgcattctgcaagcctccggagcgcacgtcggcagtcggctccctcgttgaccgaatcaccgacctctctccccagctgtatttccaaaatgtcgctttctaacaagctgacgctggacaagctggacgttaaagggaagcgggtcgttatgagagtcgacttcaatgttcctatgaagaacaaccagataacaaacaaccagaggattaaggctgctgtcccaagcatcaaattctgcttggacaatggagccaagtcggtagtccttatgagccacctaggccggcctgatggtgtgcccatgcctgacaagtactccttagagccagttgctgtagaactcaaatctctgctgggcaaggatgttctgttcttgaaggactgtgtaggcccagaagtggagaaagcctgtgccaacccagctgctgggtctgtcatcctgctggagaacctccgctttcatgtggaggaagaagggaagggaaaagatgcttctgggaacaaggttaaagccgagccagccaaaatagaagctttccgagcttcactttccaagctaggggatgtctatgtcaatgatgcttttggcactgctcacagagcccacagctccatggtaggagtcaatctgccacagaaggctggtgggtttttgatgaagaaggagctgaactactttgcaaaggccttggagagcccagagcgacccttcctggccatcctgggcggagctaaagttgcagacaagatccagctcatcaataatatgctggacaaagtcaatgagatgattattggtggtggaatggcttttaccttccttaaggtgctcaacaacatggagattggcacttctctgtttgatgaagagggagccaagattgtcaaagacctaatgtccaaagctgagaagaatggtgtgaagattaccttgcctgttgactttgtcactgctgacaagtttgatgagaatgccaagactggccaagccactgtggcttctggcatacctgctggctggatgggcttggactgtggtcctgaaagcagcaagaagtatgctgaggctgtcactcgggctaagcagattgtgtggaatggtcctgtgggggtatttgaatgggaagcttttgcccggggaaccaaagctctcatggatgaggtggtgaaagccacttctaggggctgcatcaccatcataggtggtggagacactgccacttgctgtgccaaatggaacacggaggataaagtcagccatgtgagcactgggggtggtgccagtttggagctcctggaagttcctgtgcacagcccctaagtcaacttagcattttctgcatctccacttggcattagctaaaaccttccatgtcaagattcagctagtggccaagagatgcagtgccaggaacccttaaacagttgcacagcatctcagctcatcttcactgcaccctggatttgcatacattcttcaagatcccatttgaattttttagtgactaaaccattgtgcattctagagtgcatatatttatattttgcctgttaaaaagaaagtgagcagtgttagcttagttctcttttgatgtaggttattatgattagctttgtcactgtttcactactcagcatggaaacaagatgaaattccatttgtaggtagtgagacaaaattgatgatccattaagtaaacaataaaagtgtccattgaaaccgtgatttttttttttttcctgtcatactttgttaggaagggtgagaatagaatcttgaggaacggatcagatgtctatattgctgaatgcaagaagtggggcagcagcagtggagagatgggacaattagataaatgtccattctttatcaagggcctactttatggcagacattgtgctagtgcttttattctaacttttatttttatcagttacacatgatcataatttaaaaagtcaaggcttataacaaaaaagccccagcccattcctcccattcaagattcccactccccagaggtgaccactttcaactcttgagtttttcaggtatatacctccatgtttctaagtaatatgcttatattgttcacttcttttttttttattttttaaagaaatctatttcataccatggaggaaggctctgttccacatatatttccacttcttcattctctcggtatagttttgtcacaattatagattagatcaaaagtctacataactaatacagctgagctatgtagtatgctatgattaaatttacttatgtaactttt

SEQ ID NO: 795 - DNA, 4021 bp, Homo sapiens
cagcggccgggaaggggcggtgcgggaggcggggtgtggggcggtagtgtgggccctgttcctgcccgcgcggtgttccgcattctgcaagcctccggagcgcacgtcggcagtcggctccctcgttgaccgaatcaccgacctctctccccagctgtatttccaaaatgtcgctttctaacaagctgacgctggacaagctggacgttaaagggaagcgggtcgttatgagagtcgacttcaatgttcctatgaagaacaaccagataacaaacaaccagaggattaaggctgctgtcccaagcatcaaattctgcttggacaatggagccaagtcggtagtccttatgagccacctaggccggcctgatggtgtgcccatgcctgacaagtactccttagagccagttgctgtagaactcaaatctctgctgggcaagtaagtgccaggctctggtgctggtagactttgtggcgggggaagttgtcaagcacgttgttactggtttttaactttcatactgctcaagtgtcttcatctcttcctcttctcagggatgttctgttcttgaaggactgtgtaggcccagaagtggagaaagcctgtgccaacccagctgctgggtctgtcatcctgctggagaacctccgctttcatgtggaggaagaagggaagggaaaagatgcttctgggaacaaggttaaagccgagccagccaaaatagaagctttccgagcttcactttccaagctaggggatgtctatgtcaatgatgcttttggcactgctcacagagcccacagctccatggtaggagtcaatctgccacagaaggctggtgggtttttgatgaagaaggagctgaactactttgcaaaggccttggagagcccagagcgacccttcctggccatcctgggcggagctaaagttgcagacaagatccagctcatcaataatatgctggacaaagtcaatgagatgattattggtggtggaatggcttttaccttccttaaggtgctcaacaacatggagattggcacttctctgtttgatgaagagggagccaagattgtcaaagacctaatgtccaaagctgagaagaatggtgtgaagattaccttgcctgttgactttgtcactgctgacaagtttgatgagaatgccaagactggccaagccactgtggcttctggcatacctgctggctggatgggcttggactgtggtcctgaaagcagcaagaagtatgctgaggctgtcactcgggctaagcagattgtgtggaatggtcctgtgggggtatttgaatgggaagcttttgcccggggaaccaaagctctcatggatgaggtggtgaaagccacttctaggggctgcatcaccatcataggtggtggagacactgccacttgctgtgccaaatggaacacggaggataaagtcagccatgtgagcactgggggtggtgccagtttggagctcctggaaggtaaagtccttcctggggtggatgctctcagcaatatttagtactttcctgccttttagttcctgtgcacagcccctaagtcaacttagcattttctgcatctccacttggcattagctaaaaccttccatgtcaagattcagctagtggccaagagatgcagtgccaggaacccttaaacagttgcacagcatctcagctcatcttcactgcaccctggatttgcatacattcttcaagatcccatttgaattttttagtgactaaaccattgtgcattctagagtgcatatatttatattttgcctgttaaaaagaaagtgagcagtgttagcttagttctcttttgatgtaggttattatgattagctttgtcactgtttcactactcagcatggaaacaagatgaaattccatttgtaggtagtgagacaaaattgatgatccattaagtaaacaataaaagtgtccattgaaaccgtgatttttttttttttcctgtcatactttgttaggaagggtgagaatagaatcttgaggaacggatcagatgtctatattgctgaatgcaagaagtggggcagcagcagtggagagatgggacaattagataaatgtccattctttatcaagggcctactttatggcagacattgtgctagtgcttttattctaacttttatttttatcagttacacatgatcataatttaaaaagtcaaggcttataacaaaaaagccccagcccattcctcccattcaagattcccactccccagaggtgaccactttcaactcttgagtttttcaggtatatacctccatgtttctaagtaatatgcttatattgttcacttcttttttttttattttttaaagaaatctatttcataccatggaggaaggctctgttccacatatatttccacttcttcattctctcggtatagttttgtcacaattatagattagatcaaaagtctacataactaatacagctgagctatgtagtatgctatgattaaatttacttatgtaacttttattgtctttggcattaacagtgtttcaaaaaattttctgtgtatacccatcagtgattcattcccaaatcttctagaagcataagtgtctcaatatattaaaacatattgaataatccttgttagagttatccctgcaggagtccttagtgctcctttatccaatttgtacttgatgccctctaggcagggtgtacagctagctgttgctctggtatttcctataaccttcttggggatttcttttacctcctgtgttagactcctgttttctggattcccccttttccctctttcttggtctactttttgtagaacacaagactctactagcttcctgagaaagggtgcctgggaggcaaaatctctaagactttgtaagtctgaaaatgtctttattcgacccttatacttgattcctagtttggctatatatagaattttagcctgagtatcactttttgagactcgaagccactgtttcattgtcactattgagaatctaaatggccattcggattctttcatcatctttataattttaccttcctatttctttcctgtccttttaatggagttttgggagagagcagaggtaaacatgatttgaaaaagccatgtctgaccagaaattctgtgctggcaagatatgtatttcacctttagggacaaagaaataaacttttggacaggaccacagagctagtaagtaacagcagggattcaagtccaggtttgtctggttccagtggctgatgcttttccaatgtgcctccgtccctgacatgatgcttctaggctatagatgcttctagactctatccctgacatgatgcttctagactattttgtttaaccctggatagaatagcaaaagaaaattttggtggttgctctaaacaaaacagaaatttgaaagctcaagttttttcttcatttgtattttagttaatactgtacccatatttgtagttaattttaaattgtaccatgtttctgcatacctctatgggtactcaggaattctagtccaatttttgtgactttttcctactgattacctttcctccaacgttttaaaaattatttcaaatggaactgaaagaagcataaactcccataaacccagcacctagactctacaattgccaacattatctatccaacaatctctgactgtaccttttaagtactttctactggactgtttccaggatcacccctcatttatttgggttgttaacctaaagaatgaatgggggaatctccagtcataaacaacttgtcaattaggcaaatatttgagttccttctatgtgcttaaagacgtgatagagggaatataagagcatttatgttctgaaggaatttttaacctaaccaaagaagatagtagataacttgtgtgcatataagctagaacagtataaggggccgggcatggtggcttacgcctgtaatcccaggactttgggaggccaag

SEQ ID NO: 796 - DNA, 1297 bp, Homo sapiens
gtgagagccaggcgtccctctgcctgcccactcagtggcaacacccgggagctgttttgtcctttgtggagcctcagcagttccctctttcagaactcactgccaagagccctgaacaggagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggctcaagtgctgtggcttcaccaactatacggattttgaggactcaccctacttcaaagagaacagtgcctttcccccattctgttgcaatgacaacgtcaccaacacagccaatgaaacctgcaccaagcaaaaggctcacgaccaaaaagtagagggttgcttcaatcagcttttgtatgacatccgaactaatgcagtcaccgtgggtggtgtggcagctggaattgggggcctcgagctggctgccatgattgtgtccatgtatctgtactgcaatctacaataagtccacttctgcctctgccactactgctgccacatgggaactgtgaagaggcaccctggcaagcagcagtgattgggggaggggacaggatctaacaatgtcacttgggccagaatggacctgccctttctgctccagacttggggctagatagggaccactccttttaggcgatgcctgactttccttccattggtgggtggatgggtggggggcattccagagcctctaaggtagccagttctgttgcccattcccccagtctattaaacccttgatatgccccctaggcctagtggtgatcccagtgctctactgggggatgagagaaaggcattttatagcctgggcataagtgaaatcagcagagcctctgggtggatgtgtagaaggcacttcaaaatgcataaacctgttacaatgttaaaaaaaaaaaaaaaaaaa

SEQ ID NO: 797 - DNA, 1532 bp, Homo sapiens
gtggagggcacgcagacattctgggaagccacttgccccacccctgggctgcttcttcttgagatcaggaggggcgttgcccagggctggtgttgccaggtggaggcctgctgaggcagtggttgtggggatcggtctccaggcagcagggggcagcagggtcaaggagaggctaactggccacgggtggggccagcaggcgggcagaaggaggctttaaagcgcctaccctgcctgcaggtgagcagtggtgtgtgagagccaggcgtccctctgcctgcccactcagtggcaacacccgggagctgttttgtcctttgtggagcctcagcagttccctctttcagaactcactgccaagagccctgaacaggagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggctcaagtgctgtggcttcaccaactatacggattttgaggactcaccctacttcaaagagaacagtgcctttcccccattctgttgcaatgacaacgtcaccaacacagccaatgaaacctgcaccaagcaaaaggctcacgaccaaaaagtagagggttgcttcaatcagcttttgtatgacatccgaactaatgcagtcaccgtgggtggtgtggcagctggaattgggggcctcgagctggctgccatgattgtgtccatgtatctgtactgcaatctacaataagtccacttctgcctctgccactactgctgccacatgggaactgtgaagaggcaccctggcaagcagcagtgattgggggaggggacaggatctaacaatgtcacttgggccagaatggacctgccctttctgctccagacttggggctagatagggaccactccttttaggcgatgcctgactttccttccattggtgggtggatgggtggggggcattccagagcctctaaggtagccagttctgttgcccattcccccagtctattaaacccttgatatgccccctaggcctagtggtgatcccagtgctctactgggggatgagagaaaggcattttatagcctgggcataagtgaaatcagcagagcctctgggtggatgtgtagaaggcacttcaaaatgcataaacctgttacaatgtt

SEQ ID NO: 798 - DNA, 1292 bp, Homo sapiens
gtgagcagtggtgtgtgagagccaggcgtccctctgcctgcccactcagtggcaacacccgggagctgttttgtcctttgtggagcctcagcagttccctctttcagaactcactgccaagagccctgaacaggagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggctcaagtgctgtggcttcaccaactatacggattttgaggactcaccctacttcaaagagaacagtgcctttcccccattctgttgcaatgacaacgtcaccaacacagccaatgaaacctgcaccaagcaaaaggctcacgaccaaaaagtagagggttgcttcaatcagcttttgtatgacatccgaactaatgcagtcaccgtgggtggtgtggcagctggaattgggggcctcgagctggctgccatgattgtgtccatgtatctgtactgcaatctacaataagtccacttctgcctctgccactactgctgccacatgggaactgtgaagaggcaccctggcaagcagcagtgattgggggaggggacaggatctaacaatgtcacttgggccagaatggacctgccctttctgctccagacttggggctagatagggaccactccttttaggcgatgcctgactttccttccattggtgggtggatgggtggggggcattccagagcctctaaggtagccagttctgttgcccattcccccagtctattaaacccttgatatgccccctaggcctagtggtgatcccagtgctctactgggggatgagagaaaggcattttatagcctgggcataagtgaaatcagcagagcctctgggtggatgtgtagaaggcacttcaaaatgcataaacctgttacaatgtt

SEQ ID NO: 799 - DNA, 1273 bp, Homo sapiens
tcccggcctcagacacacacaccagcagctacacctacacgctgaccatcacaggcacacagaggcacatccacctcacatccacctcatacttgtgtactctcagggttcagtctttcatcctatccctctctgatctgtgcctcccaataccttccaagatgtttacagagacccttctccctgtgcagttaggagtgtaaggcaagagagcccctacttcatggggcagatcaagagctgagaccaaagatggtctatgttgctgaccttgtcctgtcctcctgctgtcttaaactatgatccctgctgcggtcactgaagcctttccctgtgagcagtggtgtgtgagagccaggcgtccctctgcctgcccactcagtggcaacacccgggagctgttttgtcctttgtggagcctcagcagttccctctttcagaactcactgccaagagccctgaacaggagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggctcaagtgctgtggcttcaccaactatacggattttgaggactcaccctacttcaaagagaacagtgcctttcccccattctgttgcaatgacaacgtcaccaacacagccaatgaaacctgcaccaagcaaaaggctcacgaccaaaaagtagagggttgcttcaatcagcttttgtatgacatccgaactaatgcagtcaccgtgggtggtgtggcagctggaattgggggcctcgagctggctgccatgattgtgtccatgtatctgtactgcaatctacaataatgaaatcagcagagcctctgggtggatgtgtagaaggcacttcaaaatgcataaacctgttacaatgttgcca

SEQ ID NO: 800 - DNA, 1625 bp, Homo sapiens
tcccggcctcagacacacacaccagcagctacacctacacgctgaccatcacaggcacacagaggcacatccacctcacatccacctcatacttgtgtactctcagggttcagtctttcatcctatccctctctgatctgtgcctcccaataccttccaagatgtttacagagacccttctccctgtgcagttaggagtgtaaggcaagagagcccctacttcatggggcagatcaagagctgagaccaaagatggtctatgttgctgaccttgtcctgtcctcctgctgtcttaaactatgatccctgctgcggtcactgaagcctttccctgtgagcagtggtgtgtgagagccaggcgtccctctgcctgcccactcagtggcaacacccgggagctgttttgtcctttgtggagcctcagcagttccctctttcagaactcactgccaagagccctgaacaggagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggctcaagtgctgtggcttcaccaactatacggattttgaggactcaccctacttcaaagagaacagtgcctttcccccattctgttgcaatgacaacgtcaccaacacagccaatgaaacctgcaccaagcaaaaggctcacgaccaaaaagtagagggttgcttcaatcagcttttgtatgacatccgaactaatgcagtcaccgtgggtggtgtggcagctggaattgggggcctcgagctggctgccatgattgtgtccatgtatctgtactgcaatctacaataagtccacttctgcctctgccactactgctgccacatgggaactgtgaagaggcaccctggcaagcagcagtgattgggggaggggacaggatctaacaatgtcacttgggccagaatggacctgccctttctgctccagacttggggctagatagggaccactccttttaggcgatgcctgactttccttccattggtgggtggatgggtggggggcattccagagcctctaaggtagccagttctgttgcccattcccccagtctattaaacccttgatatgccccctaggcctagtggtgatcccagtgctctactgggggatgagagaaaggcattttatagcctgggcataagtgaaatcagcagagcctctgggtggatgtgtagaaggcacttcaaaatgcataaacctgttacaatgtt

SEQ ID NO: 801 - DNA, 1465 bp, Homo sapiens
gctacacctacacgctgaccatcacaggcacacagaggcacatccacctcacatccacctcatacttgtgtactctcagggttcagtctttcatcctatccctctctgatctgtgcctcccaataccttccaagatgtttacagagacccttctccctgtgcagttaggagtgtaaggcaagagagcccctacttcatggggcagatcaagagctgagaccaaagatggtctatgttgctgaccttgtcctgtcctcctgctgtcttaaactatgatccctgctgcggtcactgaagcctttccctgagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggctcaagtgctgtggcttcaccaactatacggattttgaggactcaccctacttcaaagagaacagtgcctttcccccattctgttgcaatgacaacgtcaccaacacagccaatgaaacctgcaccaagcaaaaggctcacgaccaaaaagtagagggttgcttcaatcagcttttgtatgacatccgaactaatgcagtcaccgtgggtggtgtggcagctggaattgggggcctcgagctggctgccatgattgtgtccatgtatctgtactgcaatctacaataagtccacttctgcctctgccactactgctgccacatgggaactgtgaagaggcaccctggcaagcagcagtgattgggggaggggacaggatctaacaatgtcacttgggccagaatggacctgccctttctgctccagacttggggctagatagggaccactccttttaggcgatgcctgactttccttccattggtgggtggatgggtggggggcattccagagcctctaaggtagccagttctgttgcccattcccccagtctattaaacccttgatatgccccctaggcctagtggtgatcccagtgctctactgggggatgagagaaaggcattttatagcctgggcataagtgaaatcagcagagcctctgggtggatgtgtagaaggcacttcaaaatgcataaacctgttacaatgtt

SEQ ID NO: 802 - DNA, 2749 bp, Homo sapiens
cttcccccacccgcttccggccgcggctcggttctcccgcctccgcctccgccgcggctcgtggttgtcccgccatggcactgtcgcgggggctgccccgggagctggctgaggcggtggccgggggccgggtgctggtggtgggggcgggcggcatcggctgcgagctcctcaagaatctcgtgctcaccggtttctcccacatcgacctgattgatctggatactattgatgtaagcaacctcaacagacagtttttgtttcaaaagaaacatgttggaagatcaaaggcacaggttgccaaggaaagtgtactgcagttttacccgaaagctaatatcgttgcctaccatgacagcatcatgaaccctgactataatgtggaatttttccgacagtttatactggttatgaatgctttagataacagagctgcccgaaaccatgttaatagaatgtgcctggcagctgatgttcctcttattgaaagtggaacagctgggtatcttggacaagtaactactatcaaaaagggtgtgaccgagtgttatgagtgtcatcctaagccgacccagagaacctttcctggctgtacaattcgtaacacaccttcagaacctatacattgcatcgtttgggcaaagtacttgttcaaccagttgtttggggaagaagatgctgatcaagaagtatctcctgacagagctgaccctgaagctgcctgggaaccaacggaagccgaagccagagctagagcatctaatgaagatggtgacattaaacgtatttctactaaggaatgggctaaatcaactggatatgatccagttaaactttttaccaagctttttaaagatgacatcaggtatctgttgacaatggacaaactatggcggaaaaggaaacctccagttccgttggactgggctgaagtacaaagtcaaggagaagaaacgaatgcatcagatcaacagaatgaaccccagttaggcctgaaagaccagcaggttctagatgtaaagagctatgcacgtcttttttcaaagagcatcgagactttgagagttcatttagcagaaaagggggatggagctgagctcatatgggataaggatgacccatctgcaatggattttgtcacctctgctgcaaacctcaggatgcatattttcagtatgaatatgaagagtagatttgatatcaaatcaatggcagggaacattattcctgctattgctactactaatgcagtaattgctgggttgatagtattggaaggattgaagattttatcaggaaaaatagaccagtgcagaacaatttttttgaataaacaaccaaacccaagaaagaagcttcttgtgccttgtgcactggatcctcccaaccccaattgttatgtatgtgccagcaagccagaggtgactgtgcggctgaatgtccataaagtgactgttctcaccttacaagacaagatagtgaaagaaaaatttgctatggtagcaccagatgtccaaattgaagatgggaaaggaacaatcctaatatcttccgaagagggagagacggaagctaataatcacaagaagttgtcagaatttggaattagaaatggcagccggcttcaagcagatgacttcctccaggactatactttattgatcaacatccttcatagtgaagacctaggaaaggacgttgaatttgaagttgttggtgatgccccggaaaaagtggggcccaaacaagctgaagatgctgccaaaagcataaccaatggcagtgatgatggagctcagccctccacctccacagctcaagagcaagatgacgttctcatagttgattcggatgaagaagattcttcaaataatgccgacgtcagtgaagaagagagaagccgcaagaggaaattagatgagaaagagaatctcagtgcaaagaggtcacgtatagaacagaaggaagagcttgatgatgtcatagcattagattgaacagaaatgcctctaaacagaaccctcttactatttagtttatctgggcagaaccagattgttatgtcctttgttccaaagggaaaaaattgacagcagtgacttgaaaatgattctgctccctttgaaagcattcattttgctagaactgttagacacattgcagtatgctgtattgaaagtaggaatatagttttaaaaaccctttgaacaaagtgtgtgcataaccagtcatgagataaaacaacacaatgcatgttgcctttttaatgtaaatacccgtaggtatcattaatagtttcaaaatattgtggtttagtaaagttgatacctggttataaatattatgcctttatttttggctagaagaagaattatttttagcctagatctaaccattttcatactcttaactgattgaaacagattcaaagaagtatcgagtgctatgcattgaaacttgtttttaaatgttagatggcactatgtatattaatgtaaaacaatgttaatttactcaagttttcagtttgtaccgcctggtatgtctgtgtaagaagccaatttttgtgtattgttacagtttcaggttatttatattcgatgttttgtaaaactcaaataacgactatacttatggaccaaataaatggcatctgcattcttgttacacatgcctgcacagttcctgtttctgctgccttatatctactgcaggaatgtcaaattcttttcattaaaaaaagaactcg

SEQ ID NO: 803 - DNA, 1923 bp, Homo sapiens
atggcactgtcgcgggggctgccccgggagctggctgaggcggtggccgggggccgggtgctggtggtgggggcgggcggcatcggctgcgagctcctcaagaatctcgtgctcaccggtttctcccacatcgacctgattgatctggatactattgatgtaagcaacctcaacagacagtttttgtttcaaaagaaacatgttggaagatcaaaggcacaggttgccaaggaaagtgtactgcagttttacccgaaagctaatatcgttgcctaccatgacagcatcatgaaccctgactataatgtggaatttttccgacagtttatactggttatgaatgctttagataacagagctgcccgaaaccatgttaatagaatgtgcctggcagctgatgttcctcttattgaaagtggaacagctgggtatcttggacaagtaactactatcaaaaagggtgtgaccgagtgttatgagtgtcatcctaagccgacccagagaacctttcctggctgtacaattcgtaacacaccttcagaacctatacattgcatcgtttgggcaaagtacttgttcaaccagttgtttggggaagaagatgctgatcaagaagtatctcctgacagagctgaccctgaagctgcctgggaaccaacggaagccgaagccagagctagagcatctaatgaagatggtgacattaaacgtatttctactaaggaatgggctaaatcaactggatatgatccagttaaactttttaccaagctttttaaagatgacatcaggtatctgttgacaatggacaaactatggcggaaaaggaaacctccagttccgttggactgggctgaagtacaaagtcaaggagaagaaacgaatgcatcagatcaacagaatgaaccccagttaggcctgaaagaccagcaggttctagatgtaaagagctatgcacgtcttttttcaaagagcatcgagactttgagagttcatttagcagaaaagggggatggagctgagctcatatgggataaggatgacccatctgcaatggattttgtcacctctgctgcaaacctcaggatgcatattttcagtatgaatatgaagagtagatttgatatcaaatcaatggcagggaacattattcctgctattgctactactaatgcagtaattgctgggttgatagtattggaaggattgaagattttatcaggaaaaatagaccagtgcagaacaatttttttgaataaacaaccaaacccaagaaagaagcttcttgtgccttgtgcactggatcctcccaaccccaattgttatgtatgtgccagcaagccagaggtgactgtgcggctgaatgtccataaagtgactgttctcaccttacaagacaagatagtgaaagaaaaatttgctatggtagcaccagatgtccaaattgaagatgggaaaggaacaatcctaatatcttccgaagagggagagacggaagctaataatcacaagaagttgtcagaatttggaattagaaatggcagccggcttcaagcagatgacttcctccaggactatactttattgatcaacatccttcatagtgaagacctaggaaaggacgttgaatttgaagttgttggtgatgccccggaaaaagtggggcccaaacaagctgaagatgctgccaaaagcataaccaatggcagtgatgatggagctcagccctccacctccacagctcaagagcaagatgacgttctcatagttgattcggatgaagaagattcttcaaataatgccgacgtcagtgaagaagagagaagccgcaagaggaaattagatgagaaagagaatctcagtgcaaagaggtcacgtatagaacagaaggaagagcttgatgatgtcatagcattagattga

SEQ ID NO: 804 - DNA, 3222 bp, Homo sapiens
cttcccccacccgcttccggccgcggctcggttctcccgcctccgcctccgccgcggctcgtggttgtcccgccatggcactgtcgcgggggctgccccgggagctggctgaggcggtggccgggggccgggtgctggtggtgggggcgggcggcatcggctgcgagctcctcaagaatctcgtgctcaccggtttctcccacatcgacctgattgatctggatactattgatgtaagcaacctcaacagacagtttttgtttcaaaagaaacatgttggaagatcaaaggcacaggttgccaaggaaagtgtactgcagttttacccgaaagctaatatcgttgcctaccatgacagcatcatgaaccctgactataatgtggaatttttccgacagtttatactggttatgaatgctttagataacagagctgcccgaaaccatgttaatagaatgtgcctggcagctgatgttcctcttattgaaagtggaacagctgggtatcttggacaagtaactactatcaaaaagggtgtgaccgagtgttatgagtgtcatcctaagccgacccagagaacctttcctggctgtacaattcgtaacacaccttcagaacctatacattgcatcgtttgggcaaagtacttgttcaaccagttgtttggggaagaagatgctgatcaagaagtatctcctgacagagctgaccctgaagctgcctgggaaccaacggaagccgaagccagagctagagcatctaatgaagatggtgacattaaacgtatttctactaaggaatgggctaaatcaactggatatgatccagttaaactttttaccaagctttttaaagatgacatcaggtatctgttgacaatggacaaactatggcggaaaaggaaacctccagttccgttggactgggctgaagtacaaagtcaaggagaagaaacgaatgcatcagatcaacagaatgaaccccagttaggcctgaaagaccagcaggttctagatgtaaagagctatgcacgtcttttttcaaagagcatcgagactttgagagttcatttagcagaaaagggggatggagctgagctcatatgggataaggatgacccatctgcaatggattttgtcacctctgctgcaaacctcaggatgcatattttcagtatgaatatgaagagtagatttgatatcaaatcaatggcagggaacattattcctgctattgctactactaatgcagtaattgctgggttgatagtattggaaggattgaagattttatcaggaaaaatagaccagtgcagaacaatttttttgaataaacaaccaaacccaagaaagaagcttcttgtgccttgtgcactggatcctcccaaccccaattgttatgtatgtgccagcaagccagaggtgactgtgcggctgaatgtccataaagtgactgttctcaccttacaagacaagatagtgaaagaaaaatttgctatggtagcaccagatgtccaaattgaagatgggaaaggaacaatcctaatatcttccgaagagggagagacggaagctaataatcacaagaagttgtcagaatttggaattagaaatggcagccggcttcaagcagatgacttcctccaggactatactttattgatcaacatccttcatagtgaagacctaggaaaggacgttgaatttgaagttgttggtgatgccccggaaaaagtggggcccaaacaagctgaagatgctgccaaaagcataaccaatggcagtgatgatggagctcagccctccacctccacagctcaagagcaagatgacgttctcatagttgattcggatgaagaagattcttcaaataatgccgacgtcagtgaagaagagagaagccgcaagaggaaattagatgagaaagagaatctcagtgcaaagaggtcacgtatagaacagaaggaagagcttgatgatgtcatagcattagattgaacagaaatgcctctaaacagaaccctcttactatttagtttatctgggcagaaccagattgttatgtcctttgttccaaagggaaaaaattgacagcagtgacttgaaaatgattctgctccctttgaaagcattcattttgctagaactgttagacacattgcagtatgctgtattgaaagtaggaatatagttttaaaaaccctttgaacaaagtgtgtgcataaccagtcatgagataaaacaacacaatgcatgttgcctttttaatgtaaatacccgtaggtatcattaatagtttcaaaatattgtggtttagtaaagttgatacctggttataaatattatgcctttatttttggctagaagaagaattatttttagcctagatctaaccattttcatactcttaactgattgaaacagattcaaagaagtatcgagtgctatgcattgaaacttgtttttaaatgttagatggcactatgtatattaatgtaaaacaatgttaatttactcaagttttcagtttgtaccgcctggtatgtctgtgtaagaagccaatttttgtgtattgttacagtttcaggttatttatattcgatgttttgtaaaactcaaataacgactatacttatggaccaaataaatggcatctgcattcttgttacacatgcctgcacagttcctgtttctgctgccttatatctactgcaggaatgtcaaattcttttcattaaaaaaagaactcgcctcccaaagtgctgggattacaggcgtgagccactgcgcctggcctaatggcagtgtttttaaaatttggattgtcagcagttggcctttgttgagaaaatgtgtgactttgcccaagcccagtaacttggagccttgaatttgagatgctggaaagggagtccttcctcctttctgcagtgtttgtctgggttgtcccctagtttaccaaagtccattttgaatgtaccatccccagcccaactccagcctacagatagtgccagaccgccagtaggtggagtagcactgtcttcctggtcccggacctcagagggctttgcctgttagggtactcttatcactcagagatgggccttgagttttcagagaacagaaagccattaagctgtttcccctattgtattcatgtgccctttgtgtttctggcaataatttattttatatttcaactaaattttaaatttctaat

SEQ ID NO: 805 - DNA, 4785 bp, Homo sapiens
gggactggagctgctgccgcggcgacgccggggatctttgtcgctagctcccggcccttctgccccgccgccttccctcagtcagccggcgcgggaggccgtgcggcacctgtggaatcctctcaagaggaacagtcattgtgtgaaggttcaaattcagctgttagcatggaactttcagaacctattgtagaaaatggagagacagaaatgtctccagaagaatcatgggagcacaaagaagaaataagtgaagcagagccagggggtggttccttgggagatggaaggccgccagaggaaagtgcccatgaaatgatggaggaggaagaggaaatcccaaaacctaagtctgtggttgcaccgccaggtgctcctaagaaagagcatgtaaatgtagtattcattgggcacgtagatgctggcaagtcaaccattggaggacaaataatgtatttgactggaatggttgacaaaaggacgcttgaaaagtatgaaagagaagctaaagagaaaaacagagaaacttggtacttgtcttgggccttagacacaaatcaggaagaacgagacaagggtaaaacagtagaagtgggtcgtgcctattttgaaaccgaaaagaagcatttcacaattctagatgcccctggccacaagagttttgtcccaaatatgattggtggtgcctctcaagctgatttggctgtgctggtaatctcagccaggaaaggagagtttgaaactggatttgaaaaaggaggacagacaagagaacatgcaatgttggcaaagacagcaggtgtaaaacacctaattgtgctaattaataagatggatgatccaacagtaaattggagcaatgagagatatgaagaatgtaaggagaaactagtgccatttttgaaaaaagttggcttcaatcccaaaaaggacattcactttatgccctgctcaggacttactggagcaaatctcaaagagcagtcggatttctgtccttggtacattggattaccgtttattccatatctggataatttgccgaacttcaatagatcagttgatggaccaatcaggctgccaattgtggataagtacaaggatatgggcactgtggtcctgggaaagctggaatcaggatctatttgtaaaggccagcagcttgtgatgatgccaaacaagcacaacgtggaagttcttggaatactttccgatgatgtagagactgataccgtagccccaggtgaaaacctcaaaatcagactgaaaggaattgaagaagaggagattcttccagggtttatactttgtgatcctaataatctttgtcattctggacgcacatttgatgcccagatagtgattatagagcacaaatccatcatctgcccaggctataatgcggtgctgcatattcatacctgtattgaggaggtggaaataacagccttaatctgcttggtagacaaaaaatcaggagaaaaaagtaagacccgaccccgttttgtcaaacaagatcaagtatgcattgctcgcttaaggacagcaggaaccatctgccttgagacctttaaagacttccctcagatgggtcgtttcaccttaagagatgagggtaagaccattgcaattggaaaagttctgaaactggttccagagaaagactaagcattttcttgatgaccctgcacaatactgtgaggaaaattgactgcagaagcctacttcacaccgccttctcttattttctgcccattgataaacctctccccatattttgcaaagaggaaattcacagcaaaagtccacattatgtcagctttctcatattgagagctctgctatgccactgttgaatttttcccaagattcctgtccctagccctcacttcaaactctgcttccttggacagatttggcaatagctttgtaagtgatgtggacataattgcctacaataatgaaaacctacaggaatttttttatttttcattttccccttaggcatatttagtatttttcccccaggcagatcattctgagtgtgcgagtgtgtgtgcacatgttacaaaggcaactaccatgttaataaaatattcaatttgaaatccttttcggtatttgaattgcttttgaataatgttttttatctggatgtaacattgttgcattagctttttaactttcccaagtaattgaatacattttattacttggacttttataaactctttccctacccactataaatgagacattcacagcgttcaagtttgtattaaaggaaaggattagtttgaccccttcttttgatggttaatgcatacatgcagttaaatccctttatgcaaatgtgacactgctttactaggtcttttagttatttatttattttttttttttttgccaatttatattgtaacatgatttcttgaacacagtaagttgttttaaaataaaagaacagcatactgtagtttttataagtaaagcgtaatgaaattgtacccctagagaaaattccattaacttgttaaattagtggaattaacaacaaataaagcatgtttgagacctggcaaaaattcctctggtagtatttataaatagagctgcatgcctctagtatgaaaaccgtatcagttgcaagtgccacttctacaagttactcagtttactctttgtatcagtaactttaaaggttggatgatccttgctggttaaagctaaatctcaacctagcaactaaatgaaaatatttagaatcatcagaatctgaacagactaaaattatcagcgataagcagaatcaagcagggtataagttttatctcaattatttgaaattgactgagttttcttaagtgtaaagctgaaatttgctaaccatgtttttgatgaaccacagtgcagcattgtgtgggttttagattgaatgactctctgctataattatcatgactttgaaatttttcatgagaataaatgaggaatggaggcaatttgtgggtttatccaaagcccccttgatgttgagtgttgccattgatcaaagatagcctcttttagattgtgatttctctctaaataagatactttgtatatttaatgacaagtctcttccctataattttgctcctcagaaaagaaaagcctagacagactgtatttccagtcacagaacataaaacttaatctaatgggtgttttgttttgttttgagacagaggctcactctgtcacctaggctggagtgcagtggctcgatctcagctcactgcagcctccacctcccggattcaagcaatttcctgcctcagcctcttgagtagctgggattacaggagccctccacgaggcccagttaatttttgtatctttagtggagacgaggtttccccctattggtcaggctggtctcaaacttctgacctcaagtgatccactcgcctcagcctctcaaaagtgctgggattacaggcatgaggcgccgcacttggcctagtgttttcttaactgtgaaattcccattcatttcttgaatgaggctacatcttatggacagagcaaagttattgtcctacagattcttaaaactataattatggctattgcatgaaatttaaatagattttattatgtctgcaaatctctgggcttttatttttctggaaaatataggagctttaatcaaaacataatagttctttttgtaattccatgttaataaaaacaaatactagcaattgcttgaattttaatgaatatttaaaagttcaagagccacggaaatcacttccagagataagagttccctttctaaatagaacacatttttaaaaaataagttatgtttgctactaaaacatttacactgttagactattatgtgcatgttgccaagactcttaagtaacttggatatcaactgtgaagggcctacctctaaaaagtaacaggtcatacaaatacaaatgtaactgtaaaaattccactggattcttgcatatttgcaagattagattattcaaaagaaatttcagtgctaaaattaaccagcaacataagttctatgggctttgaaaattgttctcatctttttaaagttgatgcattttcaatcctgcttacacaggctgttcatttggataagtaaataaaatgtctaaggtgaacttggcattatgtggagatgttggaccgttatagagcaatacaaattcctatgctgtcattctgttttctgcaaatgcaaacgtgcttatatggtcaacagtgcaaaaatagggtagttggctgcatatttagggtattacctaagcatttgttctctaacgttgctctactagaatgatttttttcttgcatcttttcacattaatgatgttctttatataactttcatgcgattatttagttttttaaattaataaagtgaatttaagaaatattgaaataaacatctaagtaattgccattttaaacccttgtttcttactgtgggagagggggaaatacagcactcatttcttgtattgtcttgagattaagtgacaaatagtaaagtgttactgagtaattaagcccatgtattttttttttgtgagttgaaaatctttgaaatatgtgataaccgaatgtcaaaagttcctaaactctaacagtgcaggttgttcactgtaacgaggtaactcatatttgctggttacataaactacaagtactgctctcacaatatgggactttgaactgtgatgtagttcaacagttgccggcatcctctca

SEQ ID NO: 806 - DNA, 7216 bp, Homo sapiens
ggcggcgaggggtcaatccgcgccgggggtggggttggctgtgaggccgtcggaggtggttgggtgggaggagatccgctcacacacacgaggaggagggttgagctgctgccgccgccgcctctgtcgtcgtcgcgagtgtggagtcgggactggagctgctgccgcggcgacgccggggatctttgtcgctagctcccggcccttctgccccgccgccttccctcagtcagcgttgcccactcctctccggccgggcgcccctgcctccatttctcgctctctgtccaccacacacacggcccccccgatcatggatccgggcagtggcggcggcggcggcggcggcggcggcggcgggagcagcagcggcagcagcagcagcgactcggcgcctgactgctgggaccaggcggacatggaagcccccgggccgggcccttgcggcggcggcggctccctggcggcggcggccgaggcccagcgggagaacctcagcgcggccttcagccggcaactcaacgtcaacgccaagcccttcgtgcccaacgtccacgccgccgagttcgtgccgtccttcctgcggggcccggcagcgccgccacccccagctggcggcgccgccaataaccacggagccggcagcggcgcgggaggccgtgcggcacctgtggaatcctctcaagaggaacagtcattgtgtgaaggttcaaattcagctgttagcatggaactttcagaacctattgtagaaaatggagagacagaaatgtctccagaagaatcatgggagcacaaagaagaaataagtgaagcagagccagggggtggttccttgggagatggaaggccgccagaggaaagtgcccatgaaatgatggaggaggaagaggaaatcccaaaacctaagtctgtggttgcaccgccaggtgctcctaagaaagagcatgtaaatgtagtattcattgggcacgtagatgctggcaagtcaaccattggaggacaaataatgtatttgactggaatggttgacaaaaggacgcttgaaaagtatgaaagagaagctaaagagaaaaacagagaaacttggtacttgtcttgggccttagacacaaatcaggaagaacgagacaagggtaaaacagtagaagtgggtcgtgcctattttgaaaccgaaaagaagcatttcacaattctagatgcccctggccacaagagttttgtcccaaatatgattggtggtgcctctcaagctgatttggctgtgctggtaatctcagccaggaaaggagagtttgaaactggatttgaaaaaggaggacagacaagagaacatgcaatgttggcaaagacagcaggtgtaaaacacctaattgtgctaattaataagatggatgatccaacagtaaattggagcaatgagagatatgaagaatgtaaggagaaactagtgccatttttgaaaaaagttggcttcaatcccaaaaaggacattcactttatgccctgctcaggacttactggagcaaatctcaaagagcagtcggatttctgtccttggtacattggattaccgtttattccatatctggataatttgccgaacttcaatagatcagttgatggaccaatcaggctgccaattgtggataagtacaaggatatgggcactgtggtcctgggaaagctggaatcaggatctatttgtaaaggccagcagcttgtgatgatgccaaacaagcacaacgtggaagttcttggaatactttccgatgatgtagagactgataccgtagccccaggtgaaaacctcaaaatcagactgaaaggaattgaagaagaggagattcttccagggtttatactttgtgatcctaataatctttgtcattctggacgcacatttgatgcccagatagtgattatagagcacaaatccatcatctgcccaggctataatgcggtgctgcatattcatacctgtattgaggaggtggaaataacagccttaatctgcttggtagacaaaaaatcaggagaaaaaagtaagacccgaccccgttttgtcaaacaagatcaagtatgcattgctcgcttaaggacagcaggaaccatctgccttgagacctttaaagacttccctcagatgggtcgtttcaccttaagagatgagggtaagaccattgcaattggaaaagttctgaaactggttccagagaaagactaagcattttcttgatgaccctgcacaatactgtgaggaaaattgactgcagaagcctacttcacaccgccttctcttattttctgcccattgataaacctctccccatattttgcaaagaggaaattcacagcaaaagtccacattatgtcagctttctcatattgagagctctgctatgccactgttgaatttttcccaagattcctgtccctagccctcacttcaaactctgcttccttggacagatttggcaatagctttgtaagtgatgtggacataattgcctacaataatgaaaacctacaggaatttttttatttttcattttccccttaggcatatttagtatttttcccccaggcagatcattctgagtgtgcgagtgtgtgtgcacatgttacaaaggcaactaccatgttaataaaatattcaatttgaaatccttttcggtatttgaattgcttttgaataatgttttttatctggatgtaacattgttgcattagctttttaactttcccaagtaattgaatacattttattacttggacttttataaactctttccctacccactataaatgagacattcacagcgttcaagtttgtattaaaggaaaggattagtttgaccccttcttttgatggttaatgcatacatgcagttaaatccctttatgcaaatgtgacactgctttactaggtcttttagttatttatttattttttttttttttgccaatttatattgtaacatgatttcttgaacacagtaagttgttttaaaataaaagaacagcatactgtagtttttataagtaaagcgtaatgaaattgtacccctagagaaaattccattaacttgttaaattagtggaattaacaacaaataaagcatgtttgagacctggcaaaaattcctctggtagtatttataaatagagctgcatgcctctagtatgaaaaccgtatcagttgcaagtgccacttctacaagttactcagtttactctttgtatcagtaactttaaaggttggatgatccttgctggttaaagctaaatctcaacctagcaactaaatgaaaatatttagaatcatcagaatctgaacagactaaaattatcagcgataagcagaatcaagcagggtataagttttatctcaattatttgaaattgactgagttttcttaagtgtaaagctgaaatttgctaaccatgtttttgatgaaccacagtgcagcattgtgtgggttttagattgaatgactctctgctataattatcatgactttgaaatttttcatgagaataaatgaggaatggaggcaatttgtgggtttatccaaagcccccttgatgttgagtgttgccattgatcaaagatagcctcttttagattgtgatttctctctaaataagatactttgtatatttaatgacaagtctcttccctataattttgctcctcagaaaagaaaagcctagacagactgtatttccagtcacagaacataaaacttaatctaatgggtgttttgttttgttttgagacagaggctcactctgtcacctaggctggagtgcagtggctcgatctcagctcactgcagcctccacctcccggattcaagcaatttcctgcctcagcctcttgagtagctgggattacaggagccctccacgaggcccagttaatttttgtatctttagtggagacgaggtttccccctattggtcaggctggtctcaaacttctgacctcaagtgatccactcgcctcagcctctcaaaagtgctgggattacaggcatgaggcgccgcacttggcctagtgttttcttaactgtgaaattcccattcatttcttgaatgaggctacatcttatggacagagcaaagttattgtcctacagattcttaaaactataattatggctattgcatgaaatttaaatagattttattatgtctgcaaatctctgggcttttatttttctggaaaatataggagctttaatcaaaacataatagttctttttgtaattccatgttaataaaaacaaatactagcaattgcttgaattttaatgaatatttaaaagttcaagagccacggaaatcacttccagagataagagttccctttctaaatagaacacatttttaaaaaataagttatgtttgctactaaaacatttacactgttagactattatgtgcatgttgccaagactcttaagtaacttggatatcaactgtgaagggcctacctctaaaaagtaacaggtcatacaaatacaaatgtaactgtaaaaattccactggattcttgcatatttgcaagattagattattcaaaagaaatttcagtgctaaaattaaccagcaacataagttctatgggctttgaaaattgttctcatctttttaaagttgatgcattttcaatcctgcttacacaggctgttcatttggataagtaaataaaatgtctaaggtgaacttggcattatgtggagatgttggaccgttatagagcaatacaaattcctatgctgtcattctgttttctgcaaatgcaaacgtgcttatatggtcaacagtgcaaaaatagggtagttggctgcatatttagggtattacctaagcatttgttctctaacgttgctctactagaatgatttttttcttgcatcttttcacattaatgatgttctttatataactttcatgcgattatttagttttttaaattaataaagtgaatttaagaaatattgaaataaacatctaagtaattgccattttaaacccttgtttcttactgtgggagagggggaaatacagcactcatttcttgtttttaatttgcagaagtaagtgaaaatctatgtaaaatcaaaccaaaagagttggactgagtgtgtattgtcttgagattaagtgacaaatagtaaagtgttactgagtaattaagcccatgtattttttttttgtgagttgaaaatctttgaaatatgtgataaccgaatgtcaaaagttcctaaactctaacagtgcaggttgttcactgtaacgaggtaactcatatttgctggttacataaactacaagtactgctctcacaatatgggactttgaactgtgatgtagttcaacagttgccggcatcctctcagctgatacgctgcgaatattttgggttagacttgcagccagatgcagttttgcaacccaagaaaaaagttgaacctatgatcaaaaactgctcccaagatgaacctggaaaaaaatcagctaagctcccttggcgatctgcaggaacactagtaatgactggaattactccgtgatctttgatgactattacacataacagcactctagcaccttttcttactggcatggacttcctcatggactgctacttcatggatgatagcttcattgctttgggtagggatttaaggtagtcaaggggaaaatacgcagttttattacaggtcttaacatcaggcaactttcaactttaaaaccctttgtgaaaaatgtggttatagcactatagctctgattttaggatggttaaatgttatattcattgttggcctaccttatcaaactgtgccattaatcctttcacagacataggtaaggaagagaacaaccagtggattcaggggacaattatctatctccaaataataggcttttatttcttgcagctaactttttcagtgattctagcagatgccatctagtacatccttgatcttgtttctttcgtgagagatctcgccatggcagcatcttgttaagtaagtgtaattgcacatgcacaaaagacttaactagctttacatttagcagtcagttggttagattaggtttcatagtaaatgaataggaatagaaagaataggaagtgtttttattttccagtagtaattccgtggattccatttgacccagtttactatcagttcagttcaggtagatttggttcaacttttggtggtttttggctctaggatattcttgactttaatatcctagaacttactgagtcttcccttcaataaatacacttctcacatacctctaatcctatgcttccttgaaacaataatgctagctgagttgtttactaaggattattataagggcctgaaggtgtgggagtggagattaattaaaacctttatgttctccaatataagggaaaagcaggttggtactacttctgattaggcagaaaacaccaggattccttaagtgatccttgaaatggttattgttttctgccttgtcacatttgccactgtgccctttaaaacgatgtggaaacctcaggtttgtggacagcacaggtggaatgacatcttgtgcttcctgaggctcccctctaccaggcacattagcttagtgcttcagatgtcagcccaagtccttgttacctccttttcctgctgcccagggaagagtgtgtgtgctggagctggagcgcttgcactcttcaggtgactattctcacctccatttcctccacatgcattaggtgaaactgaggtctaagcctcctgcaaggtctacattttaaggactcacacatcaggctctcagaaatgtacacaggtattagttctgtttgttctaaaggaaatgtgggtatctctcaggccaggacttagtgactagttttcgctagacagcaggttaatacctagatctcatttaaaaaaaaaaaaaaaaaacaggattaaagggaactgatcaggtttgttgagttttttagcctaattccaaagcatggaagagtgctctaggtaggaaagaaagctttttcttacgatttgtagctacctactgtgcctgacttggtgcctgtgtgaggattaagcccttagtctgctcttgcaattattcaaatgacaaattaaatttgcttttgtaataacaataaaagttgtcatcttcccttttg

SEQ ID NO: 807 - DNA, 2503 bp, Homo sapiens
gttgagccgccatatctgctgctgccgccgcagttgcgaatgcagcatcggcgcttagctgcctccgcggtgcagctaaggttcgtgtcgctaccccttggcccttcgctcttgctgccttaaccccgccggcggagcccgctcttctggcctgttgagcccgctccctcactgccacacagcaagttccgagaccatggattcgggcagcagcagcagcgactcggcgcccgattgctgggaccaggtggacatggaatccccggggtcggccccgagcggggatggagtctcctctgcggtggccgaggcccagcgcgagcccctcagctcggctttcagccgtaagctcaacgtcaacgccaagcccttcgtgcctaacgtacacgccgcggagttcgtgccgtccttcctgcggggcccgactcagccgcccaccctcccggccggctccggcagcaacgatgaaacctgcaccggcgcgggataccctcaaggtaaaaggatgggacggggggcacctgtggaaccttcccgagaggaaccgttagtgtcgcttgaaggttccaattcagccgttaccatggaactttcagaacctgttgtagaaaatggagaggtggaaatggccctagaagaatcatgggagcacagtaaagaagtaagtgaagccgagcctgggggtggttcctcgggagattcagggcccccagaagaaagtggccaggaaatgatggaggaaaaagaggaaataagaaaatccaaatctgtgatcgtaccctcaggtgcacctaagaaagaacacgtaaatgtagtattcattggccatgtagacgctggcaagtcaaccatcggaggacagataatgtttttgactggaatggttgacaaaagaacactggagaaatatgaaagagaagctaaggaaaaaaacagagaaacctggtatttgtcctgggccttagatacaaatcaggaggaacgagacaagggtaaaacagtcgaagtgggtcgtgcctattttgaaacagaaaggaaacatttcacaattttagatgcccctggccacaagagttttgtcccaaatatgattggtggtgcttctcaagctgatttggctgtgctggtcatctctgccaggaaaggagagtttgaaactggatttgaaaaaggtggacagacaagagaacatgcgatgttggcaaaaacggcaggggtaaaacatttaatagtgcttattaataagatggatgatcccacagtaaattggagcatcgagagatatgaagaatgtaaagaaaaactggtgccctttttgaaaaaagtaggcttcagtccaaaaaaggacattcactttatgccctgctcaggactgaccggagcaaatattaaagagcagtcagatttctgcccttggtacactggattaccatttattccgtatttggataacttgccaaacttcaacagatcaattgatggaccaataagactgccaattgtggataagtacaaagatatgggcactgtggtcctgggaaagctggaatccgggtccatttttaaaggccagcagctcgtgatgatgccaaacaagcacaatgtagaagttcttggaatactttctgatgatactgaaactgattttgtagccccaggtgaaaacctcaaaatcagactgaagggaattgaagaagaagagattcttccaggattcatactttgtgatcctagtaacctctgccattctggacgcacgtttgatgttcagatagtgattattgagcacaaatccatcatctgcccaggttataatgcggtgctgcacattcatacttgtattgaggaagttgagataacagcgttaatctccttggtagacaaaaaatcaggagaaaaaagtaagacacgaccccgcttcgtgaaacaagatcaagtatgcattgctcgtttaaggacagcaggaaccatctgcctcgagacgttcaaagattttcctcagatgggtcgttttactttaagagatgagggtaagaccattgcaattggaaaagttctgaaattggtcccagagaaggactaagcaattttcttgatgcctctgcaagatactgtgaggagaattgacagcaaaagttcaccacctactcttatttactgcccattgattgacttttcttcatattttgcaaagagaaatttcacagcaaaaattcatgttttgtcagctttctcatgttgagatctgttatgtcactgatgaatttaccctcaagtttccttcctctgtaccactctgcttccttggacaatatcagtaatagctttgtaagtgatgtggacgtaattgcctacagtaatgaaaaattaatgtactttaatttttcattttcttttaggatatttagaccacccttgttccacgcaaaccagagtgtgtcagtgtttgtgtgtgtgttaaaatgataactaacatgtgaataaaatactccatttgaaactc

SEQ ID NO: 808 - DNA, 2803 bp, Homo sapiens
agagtgttgagccgccatatctgctgctgccgccgcagttgcgaatgcagcatcggcgcttagctgcctccgcggtgcagctaaggttcgtgtcgctaccccttggcccttcgctcttgctgccttaaccccgccggcggagcccgctcttctggcctgttgagcccgctccctcactgccacacagcaagttccgagaccatggattcgggcagcagcagcagcgactcggcgcccgattgctgggaccaggtggacatggaatccccggggtcggccccgagcggggatggagtctcctctgcggtggccgaggcccagcgcgagcccctcagctcggctttcagccgtaagctcaacgtcaacgccaagcccttcgtgcctaacgtacacgccgcggagttcgtgccgtccttcctgcggggcccgactcagccgcccaccctcccggccggctccggcagcaacgatgaaacctgcaccggcgcgggataccctcaaggtaaaaggatgggacggggggcacctgtggaaccttcccgagaggaaccgttagtgtcgcttgaaggttccaattcagccgttaccatggaactttcagaacctgttgtagaaaatggagaggtggaaatggccctagaagaatcatgggagcacagtaaagaagtaagtgaagccgagcctgggggtggttcctcgggagattcagggcccccagaagaaagtggccaggaaatgatggaggaaaaagaggaaataagaaaatccaaatctgtgatcgtaccctcaggtgcacctaagaaagaacacgtaaatgtagtattcattggccatgtagacgctggcaagtcaaccatcggaggacagataatgtttttgactggaatggttgacaaaagaacactggagaaatatgaaagagaagctaaggaaaaaaacagagaaacctggtatttgtcctgggccttagatacaaatcaggaggaacgagacaagggtaaaacagtcgaagtgggtcgtgcctattttgaaacagaaaggaaacatttcacaattttagatgcccctggccacaagagttttgtcccaaatatgattggtggtgcttctcaagctgatttggctgtgctggtcatctctgccaggaaaggagagtttgaaactggatttgaaaaaggtggacagacaagagaacatgcgatgttggcaaaaacggcaggggtaaaacatttaatagtgcttattaataagatggatgatcccacagtaaattggagcatcgagagatatgaagaatgtaaagaaaaactggtgccctttttgaaaaaagtaggcttcagtccaaaaaaggacattcactttatgccctgctcaggactgaccggagcaaatattaaagagcagtcagatttctgcccttggtacactggattaccatttattccgtatttggataacttgccaaacttcaacagatcaattgatggaccaataagactgccaattgtggataagtacaaagatatgggcactgtggtcctgggaaagctggaatccgggtccatttttaaaggccagcagctcgtgatgatgccaaacaagcacaatgtagaagttcttggaatactttctgatgatactgaaactgattttgtagccccaggtgaaaacctcaaaatcagactgaagggaattgaagaagaagagattcttccaggattcatactttgtgatcctagtaacctctgccattctggacgcacgtttgatgttcagatagtgattattgagcacaaatccatcatctgcccaggttataatgcggtgctgcacattcatacttgtattgaggaagttgagataacagcgttaatctccttggtagacaaaaaatcaggagaaaaaagtaagacacgaccccgcttcgtgaaacaagatcaagtatgcattgctcgtttaaggacagcaggaaccatctgcctcgagacgttcaaagattttcctcagatgggtcgttttactttaagagatgagggtaagaccattgcaattggaaaagttctgaaattggtcccagagaaggactaagcaattttcttgatgcctctgcaagatactgtgaggagaattgacagcaaaagttcaccacctactcttatttactgcccattgattgacttttcttcatattttgcaaagagaaatttcacagcaaaaattcatgttttgtcagctttctcatgttgagatctgttatgtcactgatgaatttaccctcaagtttccttcctctgtaccactctgcttccttggacaatatcagtaatagctttgtaagtgatgtggacgtaattgcctacagtaatgaaaaattaatgtactttaatttttcattttcttttaggatatttagaccacccttgttccacgcaaaccagagtgtgtcagtgtttgtgtgtgtgttaaaatgataactaacatgtgaataaaatactccatttgaaactcttcggttatttgaaatgcttttgaataatgtttaaatgtcattatgtaatgctattcaattagctttattactttctcaaatagttgaatatgttctatcacttaaaaacttaaaaactcttcaccacttactgttttaagtgaggaatttacaaacaatgcataagtgtgtattaaaggaataattttaattttgagaaaaaaacgtatgttaaggctcttcccagtgggctttgttttctctgtccaagtccagtcaataaaggagctcttctgcttccccacttgtgatttg

SEQ ID NO: 809 - DNA, 1067 bp, Homo sapiens
ccgtggatacagaaatctctgcaggcaagttgctccagagcatattgcaggacaagcctgtaacgaatagttaaattcacggcatctggattcctaatccttttccgaaatggcaggtgtgagtgcctgtataaaatattctatgtttaccttcaacttcttgttctggctatgtggtatcttgatcctagcattagcaatatgggtacgagtaagcaatgactctcaagcaatttttggttctgaagatgtaggctctagctcctacgttgctgtggacatattgattgctgtaggtgccatcatcatgattctgggcttcctgggatgctgcggtgctataaaagaaagtcgctgcatgcttctgttgtttttcataggcttgcttctgatcctgctcctgcaggtggcgacaggtatcctaggagctgttttcaaatctaagtctgatcgcattgtgaatgaaactctctatgaaaacacaaagcttttgagcgccacaggggaaagtgaaaaacaattccaggaagccataattgtgtttcaagaagagtttaaatgctgcggtttggtcaatggagctgctgattggggaaataattttcaacactatcctgaattatgtgcctgtctagataagcagagaccatgccaaagctataatggaaaacaagtttacaaagagacctgtatttctttcataaaagacttcttggcaaaaaatttgattatagttattggaatatcatttggactggcagttattgagatactgggtttggtgttttctatggtcctgtattgccagatcgggaacaaatgaatctgtggatgcatcaacctatcgtcagtcaaacccctttaaaatgttgctttggctttgtaaatttaaatatgtaagtgctatataagtcaggagcagctgtctttttaaaatgtctcggctagctagaccacagatatcttctagacatattgaacacatttaagatttgagggatataagggaaaatgatatgaatgtgtatttttactcaaaataaaagtaactgtttacgttggtgctt

SEQ ID NO: 810 - DNA, 1198 bp, Homo sapiens
acttgatatctgtttactttagaggaggcagtttttgagaaaggatcataaatatcctggcccagtgccccaggagctatgacaagcaaaggaacatacttgcctggagatagcctttgcgatatttaaatccgtggatacagaaatctctgcaggcaagttgctccagagcatattgcaggacaagcctgtaacgaatagttaaattcacggcatctggattcctaatccttttccgaaatggcaggtgtgagtgcctgtataaaatattctatgtttaccttcaacttcttgttctggctatgtggtatcttgatcctagcattagcaatatgggtacgagtaagcaatgactctcaagcaatttttggttctgaagatgtaggctctagctcctacgttgctgtggacatattgattgctgtaggtgccatcatcatgattctgggcttcctgggatgctgcggtgctataaaagaaagtcgctgcatgcttctgttgtttttcataggcttgcttctgatcctgctcctgcaggtggcgacaggtatcctaggagctgttttcaaatctaagtctgatcgcattgtgaatgaaactctctatgaaaacacaaagcttttgagcgccacaggggaaagtgaaaaacaattccaggaagccataattgtgtttcaagaagagtttaaatgctgcggtttggtcaatggagctgctgattggggaaataattttcaacactatcctgaattatgtgcctgtctagataagcagagaccatgccaaagctataatggaaaacaagtttacaaagagacctgtatttctttcataaaagacttcttggcaaaaaatttgattatagttattggaatatcatttggactggcagttattgagatactgggtttggtgttttctatggtcctgtattgccagatcgggaacaaatgaatctgtggatgcatcaacctatcgtcagtcaaacccctttaaaatgttgctttggctttgtaaatttaaatatgtaagtgctatataagtcaggagcagctgtctttttaaaatgtctcggctagctagaccacagatatcttctagacatattgaacacatttaagatttgagggatataagggaaaatgatatgaatgtgtatttttactcaaaataaaagtaactgtttacgttggtgctt

SEQ ID NO: 811 - DNA, 1159 bp, Homo sapiens
agtgccccaggagctatgacaagcaaaggaacatacttgcctggagatagcctttgcgatatttaaatgtccgtggatacagaaatctctgcaggcaagttgctccagagcatattgcaggacaagcctgtaacgaatagttaaattcacggcatctggattcctaatccttttccgaaatggcaggtgtgagtgcctgtataaaatattctatgtttaccttcaacttcttgttctggctatgtggtatcttgatcctagcattagcaatatgggtacgagtaagcaatgactctcaagcaatttttggttctgaagatgtaggctctagctcctacgttgctgtggacatattgattgctgtaggtgccatcatcatgattctgggcttcctgggatgctgcggtgctataaaagaaagtcgctgcatgcttctgttgtttttcataggcttgcttctgatcctgctcctgcaggtggcgacaggtatcctaggagctgttttcaaatctaagtctgatcgcattgtgaatgaaactctctatgaaaacacaaagcttttgagcgccacaggggaaagtgaaaaacaattccaggaagccataattgtgtttcaagaagagtttaaatgctgcggtttggtcaatggagctgctgattggggaaataattttcaacactatcctgaattatgtgcctgtctagataagcagagaccatgccaaagctataatggaaaacaagtttacaaagagacctgtatttctttcataaaagacttcttggcaaaaaatttgattatagttattggaatatcatttggactggcagttattgagatactgggtttggtgttttctatggtcctgtattgccagatcgggaacaaatgaatctgtggatgcatcaacctatcgtcagtcaaacccctttaaaatgttgctttggctttgtaaatttaaatatgtaagtgctatataagtcaggagcagctgtctttttaaaatgtctcggctagctagaccacagatatcttctagacatattgaacacatttaagatttgagggatataagggaaaatgatatgaatgtgtatttttactcaaaataaaagtaactgtttacgttaaaaaaaaaaaaaaaaaaaaaaaaaaaaa

SEQ ID NO: 812 - DNA, 1216 bp, Homo sapiens
cagtgccattcccttcacttgatatctgtttactttagaggaggcagtttttgagaaaggatcataaatatcctggcccagtgccccaggagctatgacaagcaaaggaacatacttgcctggagatagcctttgcgatatttaaatgtccgtggatacagaaatctctgcaggcaagttgctccagagcatattgcaggacaagcctgtaacgaatagttaaattcacggcatctggattcctaatccttttccgaaatggcaggtgtgagtgcctgtataaaatattctatgtttaccttcaacttcttgttctggctatgtggtatcttgatcctagcattagcaatatgggtacgagtaagcaatgactctcaagcaatttttggttctgaagatgtaggctctagctcctacgttgctgtggacatattgattgctgtaggtgccatcatcatgattctgggcttcctgggatgctgcggtgctataaaagaaagtcgctgcatgcttctgttgtttttcataggcttgcttctgatcctgctcctgcaggtggcgacaggtatcctaggagctgttttcaaatctaagtctgatcgcattgtgaatgaaactctctatgaaaacacaaagcttttgagcgccacaggggaaagtgaaaaacaattccaggaagccataattgtgtttcaagaagagtttaaatgctgcggtttggtcaatggagctgctgattggggaaataattttcaacactatcctgaattatgtgcctgtctagataagcagagaccatgccaaagctataatggaaaacaagtttacaaagagacctgtatttctttcataaaagacttcttggcaaaaaatttgattatagttattggaatatcatttggactggcagttattgagatactgggtttggtgttttctatggtcctgtattgccagatcgggaacaaatgaatctgtggatgcatcaacctatcgtcagtcaaacccctttaaaatgttgctttggctttgtaaatttaaatatgtaagtgctatataagtcaggagcagctgtctttttaaaatgtctcggctagctagaccacagatatcttctagacatattgaacacatttaagatttgagggatataagggaaaatgatatgaatgtgtatttttactcaaaataaaagtaactgtttacgttggtgctt

SEQ ID NO: 813 - DNA, 1239 bp, Homo sapiens
gcggcgcctgggacggttgcggtgggtctgggcgctgggaagtcgtccaagatgattaaaaaattcgacaagaaggacgaggagtctggtagtggctccaatcctttccagcatctggagaagagtgctgttttacaggaggctcgtatattcaatgaaactccaatcaatccaagaagatgtttgcatattcttacaaagattctttacttactgaaccagggtgaacactttggaacaacggaagctacagaagccttctttgcaatgacgcgattgtttcaatctaatgatcaaacattgaggagaatgtgctaccttaccatcaaagaaatggctaccatctctgaggatgtgataattgtcacaagcagtctgactaaagacatgactggaaaagaagatgtataccgaggcccggccatcagagctctctgcaggatcaccgatggaacaatgttgcaagccattgaaagatacatgaagcaggccattgtggataaagtttccagtgtatccagttcagcactggtatcttccctgcacatgatgaagataagctatgatgtggttaagcgctggatcaatgaagcccaagaagctgcatcaagtgataatattatggtccagtaccatgcattgggagtcctgtatcaccttagaaagaatgatcgacttgctgtttccaagatgttgaataagtttactaaatctggtctcaagtcacagtttgcttactgcatgctgatccgaattgccagtcgcttactaaaagaaactgaggatggctgcaccatgaagtttacagtccgggactgtgaccctaacactggagttccagatgaggatgggtatgatgatgagtatgtgctggaagatctcgaagtgactgtgtctgaccatattcagaaagtactgaagcctaactttgctgctgcttgggaagaggtgggagatacctttgagaaagaggaaacctttgccctcagttctaccaaaacccttgaagaggctgtcaacaatatcatcacatttctgggcatgcagccatgtgagaggtccgataaagtacctgagaacaagaattcccattcgctctatctggcaggtatattcagaggtggctatgatttattggtgaggtccaggctggccttagccgatggagtgaccatgcaggtgactgtcagaagtaaagagagaacacctgtagatgttatcttagcttctgttggataa

SEQ ID NO: 814 - DNA, 3114 bp, Homo sapiens
ggggcccggaagtggtccctgtagaaccactgtggcaccgctactccgtgccgcgcccgtcgagcattgcgttgctgcattgcgccccaccgactccactatgttgaagaaattcgacaagaaggatgaggagtcaggtggaggctccaacccattccagcaccttgagaagagtgcggtactccaggaggcccgtgtatttaatgaaactcccatcaaccctcggaaatgtgcccacatcctcaccaagattctttatctcataaaccagggggagcacctggggaccacggaagcgaccgaggccttctttgccatgaccaagctctttcagtccaatgatcccacactccgtcggatgtgctacttgaccatcaaggagatgtcttgcattgcagaggatgtcatcattgtcaccagcagcctaacaaaagacatgactgggaaagaagacaactaccggggcccggccgtgcgagccctctgccagatcactgatagcaccatgctgcaggctattgagcgctacatgaaacaagccattgtggacaaggtgcccagtgtctccagctctgccctcgtgtcttccttgcacctgctgaagtgcagctttgacgtggtcaagcgctgggtgaatgaggctcaggaggcagcatccagtgataacatcatggtccagtaccacgcactagggctcctgtaccatgtgcgtaagaatgaccgcctagccgtcaataagatgatcagcaaggtcacacggcatggccttaagtctccctttgcctactgcatgatgatccgggtggccagcaagcagctggaagaggaggatggcagccgtgacagcccactgtttgacttcatcgagagctgcttgcgcaacaagcacgagatggtggtgtatgaagccgcctcggccatcgtcaatctgccaggctgcagtgccaaagagctggccccggctgtgtcagtgctccagcttttctgcagctcacccaaggctgctctccgctatgctgctgttcgtaccctcaataaggttgccatgaagcatccgtcagctgtgacagcttgtaatctggatctggagaacctggtcacagattcaaaccgcagcattgccacgctggccatcaccaccctccttaagacgggcagcgagagcagcatcgaccgcctcatgaagcagatctcctccttcatgtcagaaatctcggatgaattcaaggtggtggttgtccaggccatcagtgccctgtgtcagaaatatcctcgcaaacacgccgtccttatgaacttcctgttcaccatgctgcgggaagagggtggctttgagtataagcgcgctatcgtggactgcatcatcagcatcattgaagagaactcagagagcaaggagacagggctgtcacatctgtgcgagttcatcgaggactgcgagttcacagtgctggccacccgtattctacatctcctgggccaggaggggcccaagaccaccaatccctcaaagtacatccgcttcatctataaccgagtggtcttggagcatgaggaggtccgggcaggtgctgtgagtgctctggcgaagtttggagcccagaatgaagagatgttacccagtatcttggtgttgctgaagaggtgtgtgatggatgatgacaatgaagtaagggaccgagccaccttctacctaaatgtcctggagcagaagcagaaggcccttaatgcaggctatatcctaaatggtctgactgtgtccatccctggtctggagagggctctgcagcagtacactctagaaccatcagaaaaaccttttgacctcaagtctgtgcccctggccacggcgcccatggcagagcagagaacagaaagtacccccatcacagcagtcaaacagcctgagaaagtggcagctaccaggcaggagatcttccaggagcagttggcagcagtgccagagttccgcggtcttgggcccctcttcaagtcctcgcctgagcccgtggccctcaccgagtcagagacggagtatgtcatccgctgcaccaaacacaccttcaccaaccacatggtttttcagtttgactgcacaaacacactcaatgaccagaccttggagaatgtcacagtgcagatggagcccactgaggcctatgaggtgctctgttacgtgcctgcccggagcctgccctacaaccagcccgggacctgctacacactggtggcactgcccaaagaagaccccacagctgtggcctgcacattcagctgcatgatgaagttcactgtcaaggactgtgatcccaccactggggagactgatgacgaaggctatgaggatgagtatgtgctggaagatctggaagttactgtagctgatcacattcaaaaggtcatgaaactgaacttcgaagcagcctgggatgaggtaggggatgaatttgagaaggaggaaacgttcaccttgtctaccatcaagacacttgaagaggctgtgggtaatattgtgaagttcttgggaatgcacccttgtgagaggtcagacaaagtgccggataacaagaacacccacacgttgctcctggctggtgtgttccggggtggtcatgacatcctggtgcgctcccggctgctgcttttggacacagtgacaatgcaggtgacagccagaagtttggaggagctgccagtagacatcatcttggcatctgtgggataagaggccagcctgcataggacctcatacccttccccaacactacctggaagttgtgccttcctcatgaaactggcagaaaccccttcccaagcttctgtattgaaaaacaattaggaatcattgcagatttttttttattctgctcccacctcccacccgggactacttgctggtgactttttttttttttttttttaaataggggatgattttagcttgtcctaaatcttgctgtccacccttccaggaaagggacattgtaaatgaataaaacattctcaactcctcttgaatctatcccccaagaaaccatcttatccctgtaataaatcagcatgtatttattgaaaaaaaaaaaaaaaaaaaaaaaaaaaaaaaaaaaaaaaaaa

SEQ ID NO: 815 - DNA, 3116 bp, Homo sapiens
ttccgctcgccggctgcggcgcctgggacggttgcggtgggtctgggcgctgggaagtcgtccaagatgattaaaaaattcgacaagaaggacgaggagtctggtagtggctccaatcctttccagcatctggagaagagtgctgttttacaggaggctcgtatattcaatgaaactccaatcaatccaagaagatgtttgcatattcttacaaagattctttacttactgaaccagggtgaacactttggaacaacggaagctacagaagccttctttgcaatgacgcgattgtttcaatctaatgatcaaacattgaggagaatgtgctaccttaccatcaaagaaatggctaccatctctgaggatgtgataattgtcacaagcagtctgactaaagacatgactggaaaagaagatgtataccgaggcccggccatcagagctctctgcaggatcaccgatggaacaatgttgcaagccattgaaagatacatgaagcaggccattgtggataaagtttccagtgtatccagttcagcactggtatcttccctgcacatgatgaagataagctatgatgtggttaagcgctggatcaatgaagcccaagaagctgcatcaagtgataatattatggtccagtaccatgcattgggagtcctgtatcaccttagaaagaatgatcgacttgctgtttccaagatgttgaataagtttactaaatctggtctcaagtcacagtttgcttactgcatgctgatccgaattgccagtcgcttactaaaagaaactgaggatggccatgaaagtccactgtttgatttcattgagagctgcttgcgaaataaacatgaaatggttatttatgaagctgcttcagctatcatccatcttcctaactgcactgcaagagagttggcacctgctgtttcagttcttcaacttttctgtagttctcctaagccagccttgagatatgcagctgtgaggaccttgaacaaggtggcaatgaagcacccctctgctgttactgcctgcaatctggacttagaaaacttaatcacagactcaaacagaagcattgctaccttagccattactacactcctcaaaacaggaagtgagagcagtgtggaccggctcatgaagcagatatcttcttttgtgtctgaaatctcagatgagttcaaggtggtggttgtacaggcaattagtgctctctgtcagaaataccctcgaaagcacagtgtcatgatgactttcctctccaacatgctccgagatgatggaggctttgagtacaagcgggccattgtggactgtataatcagcattgtggaagagaaccctgagagtaaagaagcaggcctagcccacctttgtgaattcattgaggactgtgaacacactgttctggctactaagattctacacttgttgggcaaagagggccctagaacgcctgtcccctccaaatatatccgttttatttttaatagggttgtcctggagaatgaggctgtcagagctgctgctgtgagtgctttggctaaatttggggctcagaatgagagtcttctcccaagcatccttgtactcttacagaggtgtatgatggatactgatgacgaggtacgagacagagctaccttctatctgaatgtgctgcagcagaggcagatggcactaaatgccacatatatctttaatggtttgacggtctctgtaccagggatggaaaaagccttacaccagtacacgttggagccttcagaaaaaccgtttgacatgaaatcaattcctcttgctatggctcctgtctttgaacagaaagcagaaatcacacttgtggctactaagccagagaagttggctccttccaggcaagacattttccaagaacaattggctgccattcctgagtttctgaatataggacccttgttcaagtcttctgagcctgttcaacttacagaagcagagacagaatattttgttcgatgtatcaagcacatgtttaccaatcacatcgtgttccagtttgactgcaccaacactctcaatgaccagctgctggaaaaagtgacagtgcagatggagccatcagattcctatgaagtgctgtcttgtatcccagcccccagccttccttataaccaaccaggaatatgttacactcttgttcgtttgcctgatgatgaccctacagcagttgcaggctcctttagctgcaccatgaagtttacagtccgggactgtgaccctaacactggagttccagatgaggatgggtatgatgatgagtatgtgctggaagatctcgaagtgactgtgtctgaccatattcagaaagtactgaagcctaactttgctgctgcttgggaagaggtgggagatacctttgagaaagaggaaacctttgccctcagttctaccaaaacccttgaagaggctgtcaacaatatcatcacatttctgggcatgcagccatgtgagaggtccgataaagtacctgagaacaagaattcccattcgctctatctggcaggtatattcagaggtggctatgatttattggtgaggtccaggctggccttagccgatggagtgaccatgcaggtgactgtcagaagtaaagagagaacacctgtagatgttatcttagcttctgttggataaatgcttactggacaagaggaaactgatgcacactacatggtcagtgggcttttaggctagtggcatcagtttcccagaatcagacttttgaagatgaatgactttggagaagcaaattaaacatttggccctgagccagcagatcaagcaaatgtctatctttgcgcatgggttgttttttttttttttctttttattctacttggtcagctttgggacgatagtgcagctttgggtgatcttgaaaatcaaatactatcctatactccagctgcttaacttcattttattctttaatgtgtacctgaaagctcctggcaatgctggaaaatttttatcccagaggggtgggggggaggggggaggggaagccagagtccacttttgtcacaattcatttttattaatagaaaataaacacttattccagtttc

SEQ ID NO: 816 - DNA, 3100 bp, Homo sapiens
gggctgcggcgcctgggacggttgcggtgggtctgggcgctgggaagtcgtccaagatgattaaaaaattcgacaagaaggacgaggagtctggtagtggctccaatcctttccagcatctggagaagagtgctgttttacaggaggctcgtatattcaatgaaactccaatcaatccaagaagatgtttgcatattcttacaaagattctttacttactgaaccagggtgaacactttggaacaacggaagctacagaagccttctttgcaatgacgcgattgtttcaatctaatgatcaaacattgaggagaatgtgctaccttaccatcaaagaaatggctaccatctctgaggatgtgataattgtcacaagcagtctgactaaagacatgactggaaaagaagatgtataccgaggcccggccatcagagctctctgcaggatcaccgatggaacaatgttgcaagccattgaaagatacatgaagcaggccattgtggataaagtttccagtgtatccagttcagcactggtatcttccctgcacatgatgaagataagctatgatgtggttaagcgctggatcaatgaagcccaagaagctgcatcaagtgataatattatggtccagtaccatgcattgggagtcctgtatcaccttagaaagaatgatcgacttgctgtttccaagatgttgaataagtttactaaatctggtctcaagtcacagtttgcttactgcatgctgatccgaattgccagtcgcttactaaaagaaactgaggatggccatgaaagtccactgtttgatttcattgagagctgcttgcgaaataaacatgaaatggttatttatgaagctgcttcagctatcatccatcttcctaactgcactgcaagagagttggcacctgctgtttcagttcttcaacttttctgtagttctcctaagccagccttgagatatgcagctgtgaggaccttgaacaaggtggcaatgaagcacccctctgctgttactgcctgcaatctggacttagaaaacttaatcacagactcaaacagaagcattgctaccttagccattactacactcctcaaaacaggaagtgagagcagtgtggaccggctcatgaagcagatatcttcttttgtgtctgaaatctcagatgagttcaaggtggtggttgtacaggcaattagtgctctctgtcagaaataccctcgaaagcacagtgtcatgatgactttcctctccaacatgctccgagatgatggaggctttgagtacaagcgggccattgtggactgtataatcagcattgtggaagagaaccctgagagtaaagaagcaggcctagcccacctttgtgaattcattgaggactgtgaacacactgttctggctactaagattctacacttgttgggcaaagagggccctagaacgcctgtcccctccaaatatatccgttttatttttaatagggttgtcctggagaatgaggctgtcagagctgctgctgtgagtgctttggctaaatttggggctcagaatgagagtcttctcccaagcatccttgtactcttacagaggtgtatgatggatactgatgacgaggtacgagacagagctaccttctatctgaatgtgctgcagcagaggcagatggcactaaatgccacatatatctttaatggtttgacggtctctgtaccagggatggaaaaagccttacaccagtacacgttggagccttcagaaaaaccgtttgacatgaaatcaattcctcttgctatggctcctgtctttgaacagaaagcagaaatcacacttgtggctactaagccagagaagttggctccttccaggcaagacattttccaagaacaattggctgccattcctgagtttctgaatataggacccttgttcaagtcttctgagcctgttcaacttacagaagcagagacagaatattttgttcgatgtatcaagcacatgtttaccaatcacatcgtgttccagtttgactgcaccaacactctcaatgaccagctgctggaaaaagtgacagtgcagatggagccatcagattcctatgaagtgctgtcttgtatcccagcccccagccttccttataaccaaccaggaatatgttacactcttgttcgtttgcctgatgatgaccctacagcagttgcaggctcctttagctgcaccatgaagtttacagtccgggactgtgaccctaacactggagttccagatgaggatgggtatgatgatgagtatgtgctggaagatctcgaagtgactgtgtctgaccatattcagaaagtactgaagcctaactttgctgctgcttgggaagaggtgggagatacctttgagaaagaggaaacctttgccctcagttctaccaaaacccttgaagaggctgtcaacaatatcatcacatttctgggcatgcagccatgtgagaggtccgataaagtacctgagaacaagaattcccattcgctctatctggcaggtatattcagaggtggctatgatttattggtgaggtccaggctggccttagccgatggagtgaccatgcaggtgactgtcagaagtaaagagagaacacctgtagatgttatcttagcttctgttggataaatgcttactggacaagaggaaactgatgcacactacatggtcagtgggcttttaggctagtggcatcagtttcccagaatcagacttttgaagatgaatgactttggagaagcaaattaaacatttggccctgagccagcagatcacaagaaatgtctatctttgcgcatgggttgttttttttttttttctttttattctacttggtcagctttgggacgatagtgcagctttgggtgatcttgaaaatcaaatactatcctatactccagctgcttaacttcattttattctttaatgtgtacctgaaagctcctggcaatgctggaaaatttttatcccagaggggtgggggtgaggggggaggggaagccagagtccacttttgtcacaattcatttttattaatagaaaataaacacttattc

SEQ ID NO: 817 - DNA, 3083 bp, Homo sapiens
cagtcggggcccggaagtggtccctgtagaaccactgtggcaccgctactccgtgccgcgcccgtcgagcattgcgttgctgcattgcgccccaccgactccactatgttgaagaaattcgacaagaaggatgaggagtcaggtggaggctccaacccattccagcaccttgagaagagtgcggtactccaggaggcccgtgtatttaatgaaactcccatcaaccctcggaaatgtgcccacatcctcaccaagattctttatctcataaaccagggggagcacctggggaccacggaagcgaccgaggccttctttgccatgaccaagctctttcagtccaatgatcccacactccgtcggatgtgctacttgaccatcaaggagatgtcttgcattgcagaggatgtcatcattgtcaccagcagcctaacaaaagacatgactgggaaagaagacaactaccggggcccggccgtgcgagccctctgccagatcactgatagcaccatgctgcaggctattgagcgctacatgaaacaagccattgtggacaaggtgcccagtgtctccagctctgccctcgtgtcttccttgcacctgctgaagtgcagctttgacgtggtcaagcgctgggtgaatgaggctcaggaggcagcatccagtgataacatcatggtccagtaccacgcactagggctcctgtaccatgtgcgtaagaatgaccgcctagccgtcaataagatgatcagcaaggtcacacggcatggccttaagtctccctttgcctactgcatgatgatccgggtggccagcaagcagctggaagaggaggatggcagccgtgacagcccactgtttgacttcatcgagagctgcttgcgcaacaagcacgagatggtggtgtatgaagccgcctcggccatcgtcaatctgccaggctgcagtgccaaagagctggccccggctgtgtcagtgctccagcttttctgcagctcacccaaggctgctctccgctatgctgctgttcgtaccctcaataaggttgccatgaagcatccgtcagctgtgacagcttgtaatctggatctggagaacctggtcacagattcaaaccgcagcattgccacgctggccatcaccaccctccttaagacgggcagcgagagcagcatcgaccgcctcatgaagcagatctcctccttcatgtcagaaatctcggatgaattcaaggtggtggttgtccaggccatcagtgccctgtgtcagaaatatcctcgcaaacacgccgtccttatgaacttcctgttcaccatgctgcgggaagagggtggctttgagtataagcgcgctatcgtggactgcatcatcagcatcattgaagagaactcagagagcaaggagacagggctgtcacatctgtgcgagttcatcgaggactgcgagttcacagtgctggccacccgtattctacatctcctgggccaggaggggcccaagaccaccaatccctcaaagtacatccgcttcatctataaccgagtggtcttggagcatgaggaggtccgggcaggtgctgtgagtgctctggcgaagtttggagcccagaatgaagagatgttacccagtatcttggtgttgctgaagaggtgtgtgatggatgatgacaatgaagtaagggaccgagccaccttctacctaaatgtcctggagcagaagcagaaggcccttaatgcaggctatatcctaaatggtctgactgtgtccatccctggtctggagagggctctgcagcagtacactctagaaccatcagaaaaaccttttgacctcaagtctgtgcccctggccacggcgcccatggcagagcagagaacagaaagtacccccatcacagcagtcaaacagcctgagaaagtggcagctaccaggcaggagatcttccaggagcagttggcagcagtgccagagttccgcggtcttgggcccctcttcaagtcctcgcctgagcccgtggccctcaccgagtcagagacggagtatgtcatccgctgcaccaaacacaccttcaccaaccacatggtttttcagtttgactgcacaaacacactcaatgaccagaccttggagaatgtcacagtgcagatggagcccactgaggcctatgaggtgctctgttacgtgcctgcccggagcctgccctacaaccagcccgggacctgctacacactggtggcactgcccaaagaagaccccacagctgtggcctgcacattcagctgcatgatgaagttcactgtcaaggactgtgatcccaccactggggagactgatgacgaaggctatgaggatgagtatgtgctggaagatctggaagttactgtagctgatcacattcaaaaggtcatgaaactgaacttcgaagcagcctgggatgaggtaggggatgaatttgagaaggaggaaacgttcaccttgtctaccatcaagacacttgaagaggctgtgggtaatattgtgaagttcttgggaatgcacccttgtgagaggtcagacaaagtgccggataacaagaacacccacacgttgctcctggctggtgtgttccggggtggtcatgacatcctggtgcgctcccggctgctgcttttggacacagtgacaatgcaggtgacagccagaagtttggaggagctgccagtagacatcatcttggcatctgtgggataagaggccagcctgcataggacctcatacccttccccaacactacctggaagttgtgccttcctcatgaaactggcagaaaccccttcccaagcttctgtattgaaaaacaattaggaatcattgcagatttttttttattctgctcccacctcccacccgggactacttgctggtgacttttttttttttttttttttaaataggggatgattttagcttgtcctaaatcttgctgtccacccttccaggaaagggacattgtaaatgaataaaacattctcaactcctcttgaatctatcccccaagaaaccatcttatccctgtaataaatcagcatgtatttattgaatga

SEQ ID NO: 818 - DNA, 1042 bp, Homo sapiens
ggtggctccattttccatttgagctcaaatattttgctgcttcctctgtagctgccagacctgctcttgctgctgctcaggtagaacatctgggaggtcccttgctgaccactggaagaagatgagctcgagctattggagtgagacgagcagcagcagctgtggaacccagcagctcccagaggtgctgcagtgccagccccagcattaccactgctaccatcagtcaagccaagcccagcagcctccagaaaaaaatgtagtgtatgagcgagtgaggacctacagtgggcccatgaacaaggtggtgcaggccttggaccccttcaactcacgggaagtgctctcccctctcaaaaccacctcctcctaccaaaatttggtttggagcgaccattctcaggaactccattctccaactttaaaaatatctacatgtgccccaagtactctacatataacccaaaatactgaacaggaacttcattctccaacagtgaaacttactacatatccacagaccactattaggaaatatgtagtacaaaatcctgaacaggaaccactgtctcaattcctaagaggaagccatttcttcccaggaaacaatgttatttatgaaaaaacaataagaaaagtggagaagctaaatactgatcaggggtgccatcctcaggctcaatgccatcatcacattatccaacagccccaggtcatccactctgcacactggcaacaacctgattctagccagcaaatccaagccatcacaggaaataatccaatttctacacatattggaaatgaactgtgccatagtggatcaagccagatttgtgagcaggtgataattcaggatgatggccctgaaaaattggaccccagatattttggagagttgcttgctgatctgagccgtaagaatacggatctatatcactgcttattagaacatttgcagagaattggaggaagaaaacaatctctctcttcgacatacactatcagacatggaatacagactaaaagaactggaatattg

SEQ ID NO: 819 - DNA, 3916 bp, Homo sapiens
ggtggctccattttccatttgagctcaaatattttgctgcttcctctgtagctgccagacctgctcttgctgctgctcaggtagaacatctgggaggtcccttgctgaccactggaagaagatgagctcgagctattggagtgagacgagcagcagcagctgtggaacccagcagctcccagaggtgctgcagtgccagccccagcattaccactgctaccatcagtcaagccaagcccagcagcctccagaaaaaaatgtagtgtatgagcgagtgaggacctacagtgggcccatgaacaaggtggtgcaggccttggaccccttcaactcacgggaagtgctctcccctctcaaaaccacctcctcctaccaaaatttggtttggagcgaccattctcaggaactccattctccaactttaaaaatatctacatgtgccccaagtactctacatataacccaaaatactgaacaggaacttcattctccaacagtgaaacttactacatatccacagaccactattaggaaatatgtagtacaaaatcctgaacaggaaccactgtctcaattcctaagaggaagccatttcttcccaggaaacaatgttatttatgaaaaaacaataagaaaagtggagaagctaaatactgatcaggggtgccatcctcaggctcaatgccatcatcacattatccaacagccccaggtcatccactctgcacactggcaacaacctgattctagccagcaaatccaagccatcacaggaaataatccaatttctacacatattggaaatgaactgtgccatagtggatcaagccagatttgtgagcaggtgataattcaggatgatggccctgaaaaattggaccccagatattttggagagttgcttgctgatctgagccgtaagaatacggatctatatcactgcttattagaacatttgcagagaattggaggaagcaaacaggactttgagtctacagatgagtcggaagacattgaatcattgattcctaaaggattatcagagtttacaaaacagcaaatacgctacattctgcagatgaggggtatgtctgataagtcactccgactagtgctgtccacatttagcaacatacgggaggagcttggacatcttcaaaatgatttgacatcactggaaaatgacaagatgagacttgagaaagatttatcattcaaagacactcaattaaaagagtacgaagaactcttggcatcagtgagagcaaataatcaccagcagcagcaaggacttcaagactcaagttcaaaatgccaggcattggaagaaaacaatctctctcttcgacatacactatcagacatggaatacagactaaaagaactggaatattgtaaacgtaatttagagcaagagaatcaaaaccttagaatgcaggtttctgagacttgcacaggcccaatgttgcaggctaaaatggatgagattggcaaccactacacggagatggtaaaaaacttgagaatggagaaagatagagagatctgcagactgaggtcccaattaaaccagtaccataaagatgtttcaaagagagaaggaagttgtagtgacttccaatttaagcttcatgaactgacaagcttgctggaagagaaggattccctcataaagcgtcagtcagaggaactctccaagttgcggcaagaaatatattcctctcataaccaaccctccactggtggaaggactactattaccactaaaaagtacaggacacaatatccaatcctaggcctcctatatgatgactacgaatatataccaccaggtagtgaaacacagactattgtgattgagaaaacagaagacaaatacacttgtccatgaatggatccactttaaagtattacaactcaaagccgttttttttttgtgtgtgtgtctctgcattagtactttgttatttttccatcactaaaggccaatcagaatttggaaccatgctgctacccaagaaatctaatggaatgaattagttctgtagatgacaatttcttcacccatttatgagacctaaatcttttccataacactcatgtattcagtataacaacatactaactgaaagagggacctgattgtttaaagtttgattgcagacactgtagaacataactcattatgtttcagataaggtaactcctagatatcaaactaatttgttggggtagagattttacaagtcatgccattagaagattttctctgatattatatgtgcagttcagttacaagatgaaatcatgtttttttaacaaaagagataaaatacaattgaagcaaaaaataacagctagtatataatatatacagtctgtatttgcttttcacagtaggcctgatgactaaaagatatgctttattacacgctattttcacctcttgaaagtcaaaggtgatgattaatttcatttagcagggaagtggaataatatcttttgaaataactaagtccactaaattatacagtatgctattctggttctaagtacatattagtcccttggcaaatctgttctttcaaagcataccttccccaaatgagcctacctacttcttaaaaaacatataacacaatgtggtagtagtaggtgtaaggaaggtaagttttttcatagtggtatgcaaacatatcattgaaatattacatagatataaagacttagggaataaaaatagcagcaacaaatacttgatagatttatcctacttgggagaaatattttgtagcagagtatttagtatacttagaagttgatttagcaattaggctttaatgaccttacaaagtgaacataactgaacacaagtattttttcaatgcaagatgaggatgaaaattttacatttcaacccatctggctaaagttaagacttagcaaaaattaaaatgttgcctttgtccaagtatagattaaggcaacaaacatatttgggtgtgtaatttgaagttttggactgaaatatctttgcaagtatccacataaaattctgtaatgccttataattatattctaataattatgcattatactaagacaccattaagaacagttgaggcactacactaaatcaaaccataaatgaggaaaaaacttttaatgttcttttctagaagtgttcaaataggtcttgatatgaagctaaaagccttatttatattatcttaatatttcggctaaaatgttaagctccataacatgaattgatacaattccaattttatcaatattttgtgatagaaaaatgttaatattattcatgagctatacagtccttacattttttcccttggtgtaggaacaacggaggagtttctcctctgctaactattcatatatgtaactgtaacaaaagtgtactatgttatgcacacattacaaataatataaggggaagttttattagcttagtaggaaattgttattattaaggtttaaaaatgagaacaggtgtgagttttccaaaatacttaaaaataatagtgtcaaaaattcaggggcagttaaggagtcatggatggaactagaggtcactatattaagtgacataagccagaaacagacaaacattgcatgttctcaattatttgcgggatctaaaagtcaaaacaattgaactcatggatatagagagtagaaggatggttactagtggctgggaaaaggggtgtgcgaggggaactggggatgcttaatgtgtacaaaaactatgtagttagaaagtataaataagacctagtatttgatagcacaaccgggtgagtatagtcaataatagcttaattgtacaaataactaagagtataattggattgtttgtaacacaaataaatacttgagtggatggata

SEQ ID NO: 820 - DNA, 1906 bp, Homo sapiens
ggtggctccattttccatttgagctcaaatattttgctgcttcctctgtagctgccagacctgctcttgctgctgctcaggtagaacatctgggaggtcccttgctgaccactggaagaagatgagctcgagctattggagtgagacgagcagcagcagctgtggaacccagcagctcccagaggtgctgcagtgccagccccagcattaccactgctaccatcagtcaagccaagcccagcagcctccagaaaaaaatgtagtgtatgagcgagtgaggacctacagtgggcccatgaacaaggtggtgcaggccttggaccccttcaactcacgggaagtgctctcccctctcaaaaccacctcctcctaccaaaatttggtttggagcgaccattctcaggaactccattctccaactttaaaaatatctacatgtgccccaagtactctacatataacccaaaatactgaacaggaacttcattctccaacagtgaaacttactacatatccacagaccactattaggaaatatgtagtacaaaatcctgaacaggaaccactgtctcaattcctaagaggaagccatttcttcccaggaaacaatgttatttatgaaaaaacaataagaaaagtggagaagctaaatactgatcaggggtgccatcctcaggctcaatgccatcatcacattatccaacagccccaggtcatccactctgcacactggcaacaacctgattctagccagcaaatccaagccatcacaggaaataatccaatttctacacatattggaaatgaactgtgccatagtggatcaagccagatttgtgagcaggtgataattcaggatgatggccctgaaaaattggaccccagatattttggagagttgcttgctgatctgagccgtaagaatacggatctatatcactgcttattagaacatttgcagagaattggaggaagcaaacaggactttgagtctacagatgagtcggaagacattgaatcattgattcctaaaggattatcagagtttacaaaacagcaaatacgctacattctgcagatgaggggtatgtctgataagtcactccgactagtgctgtccacatttagcaacatacgggaggagcttggacatcttcaaaatgatttgacatcactggaaaatgacaagatgagacttgagaaagatttatcattcaaagacactcaattaaaagagtacgaagaactcttggcatcagtgagagcaaataatcaccagcagcagcaaggacttcaagactcaagttcaaaatgccaggcattggaagaaaacaatctctctcttcgacatacactatcagacatggaatacagactaaaagaactggaatattgtaaacgtaatttagagcaagagaatcaaaaccttagaatgcaggtttctgagacttgcacaggcccaatgttgcaggctaaaatggatgagattggcaaccactacacggagatggtaaaaaacttgagaatggagaaagatagagagatctgcagactgaggtcccaattaaaccagtaccataaagatgtttcaaagagagaaggaagttgtagtgacttccaatttaagcttcatgaactgacaagcttgctggaagagaaggattccctcataaagcgtcagtcagaggaactctccaagttgcggcaagaaatatattcctctcataaccaaccctccactggtggaaggactactattaccactaaaaagtacaggacacaatatccaatcctaggcctcctatatgatgactacgaatatataccaccaggtagtgaaacacagactattgtgattgagaaaacagaagacaaatacacttgtgtaagttcacttgggcatttt

SEQ ID NO: 821 - DNA, 856 bp, Homo sapiens
aggtgatcagtgggacgagtaaggaaggggggttgggagaggggcgattgggcaacccggctgcacaaacacgggaggtcaaagattgcgcccagcccgcccaggccgggaatggaataaagggacgcggggcgccggaggctgcacagaagcgagtccgactgtgctcgctgctcagcgccgcacccggaggatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccagctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgtctgaaggatggtgctggggatgtggcctttgtcaagcactcgactatatttgagaacttggcaaacaaggctgacagggaccagtatgagctgctttgcctggacaacacccggaagccggtagatgaatacaaggactgccacttggcccaggtcccttctcataccgtcgtggcccgaagtatgggcggcaaggaggacttgat

SEQ ID NO: 822 - DNA, 2770 bp, Homo sapiens
tgacaatggctgcattgtgcttcatgtcccttcccatcaacatttctgtgctggactccttccactcgcgggtcgtctccagagctcagaaaatgaggtgatcagtgggacgagtaaggaaggggggttgggagaggggcgattgggcaacccggctgcacaaacacgggaggtcaaagattgcgcccagcccgcccaggccgggaatggaataaagggacgcggggcgccggaggctgcacagaagcgagtccgactgtgctcgctgctcagcgccgcacccggaggatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgtctgaaggatggtgctggggatgtggcctttgtcaagcactcgactatatttgagaacttggcaaacaaggctgacagggaccagtatgagctgctttgcctggacaacacccggaagccggtagatgaatacaaggactgccacttggcccaggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaaggactctgcccacgggtttttaaaagtcccccccaggatggatgccaagatgtacctgggctatgagtatgtcactgccatccggaatctacgggaaggcacatgcccagaagccccaacagatgaatgcaagcctgtgaagtggtgtgcgctgagccaccacgagaggctcaagtgtgatgagtggagtgttaacagtgtagggaaaatagagtgtgtatcagcagagaccaccgaagactgcatcgccaagatcatgaatggagaagctgatgccatgagcttggatggagggtttgtctacatagcgggcaagtgtggtctggtgcctgtcttggcagaaaactacaataagagcgataattgtgaggatacaccagaggcagggtattttgctgtagcagtggtgaagaaatcagcttctgacctcacctgggacaatctgaaaggcaagaagtcctgccatacggcagttggcagaaccgctggctggaacatccccatgggcctgctctacaataagatcaaccactgcagatttgatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttcaaaaactccattctttcctaaatattttcaacaaaggatttctttatgcattctgcctaaatacctatgcaactgagcccttccttctcagctcaagattcgtctggtctttccctacagctttgtgtgtgccatggccacatctcctgggtacagttcaaggagacatcttttctaaaagggtctgcgtgatcattaaaatataatcaaatgt

SEQ ID NO: 823 - DNA, 2298 bp, Homo sapiens
tgtgctcgctgctcagcgcgcacccggaagatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacttggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgtctgaaggatggtgctggggatgtggcctttgtcaagcactcgactatatttgagaacttggcaaacaaggctgacagggaccagtatgagctgctttgcctagacaacacccggaagccggtagatgaatacaaggactgccacttggcccaggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaaggactctgcccacgggtttttaaaagtccccccaaggatggatgccaagatgtacctgggctatgagtatgtcactgccatccggaatctacgggaaggcacatgcccagaagccccaacagatgaatgcaagcctgtgaagtggtgtgcgctgagccaccacgagaggctcaagtgtgatgagtggagtgttaacagtgtagggaaaatagagtgtgtatcagcagagaccaccgaagactgcatcgccaagatcatgaatggagaagctgatgccatgagcttggatggagggtttgtctacatagcgggcaagtgtggtctggtgcctgtcttggcagaaaactacaataagagcgataattgtgaggatacaccagaggcagggtattttgctgtagcagtggtgaagaaatcagcttctgacctcacctgggacaatctgaaaggcaagaagtcctgccatacggcagttggcagaaccgctggctggaacatccccatgggcctgctctacaataagatcaaccactgcagatttgatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttc

SEQ ID NO: 824 - DNA, 2344 bp, Homo sapiens
cgactgtgctcgctgctcagcgccgcacccggaggatgaggctcgccgtgggagccctgctggtctgcgccgtcctgggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgtctgaaggatggtgctggggatgtggcctttgtcaagcactcgactatatttgagaacttggcaaacaaggctgacagggaccagtatgagctgctttgcctggacaacacccggaagccggtagatgaatacaaggactgccacttggcccaggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaaggactctgcccacgggtttttaaaagtcccccccaggatggatgccaagatgtacctgggctatgagtatgtcactgccatccggaatctacgggaaggcacatgcccagaagccccaacagatgaatgcaagcctgtgaagtggtgtgcgctgagccaccacgagaggctcaagtgtgatgagtggagtgttaacagtgtagggaaaatagagtgtgtatcagcagagaccaccgaagactgcatcgccaagatcatgaatggagaagctgatgccatgagcttggatggagggtttgtctacatagcgggcaagtgtggtctggtgcctgtcttggcagaaaactacaataagagcgataattgtgaggatacaccagaggcagggtattttgctgtagcagtggtgaagaaatcagcttctgacctcacctgggacaatctgaaaggcaagaagtcctgccatacggcagttggcagaaccgctggctggaacatccccatgggcctgctctacaataagatcaaccactgcagatttgatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttcaaaaactccattctttcctaaatattttcaacaaaggatttctttatgcattctgcctaaatacctatgcaactgagcccttccttctcagctcaagattcgtctggtctttccctacagctttgtgtgtgccatggccacatctcctgggtacagttcaaggagacatcttttctaaaagggtctgcgtgatcattaaaatataatcaaatgt

SEQ ID NO: 825 - DNA, 2526 bp, Homo sapiens
cagccaccgcgacggagcccgcaggcgggaacctgcctccgcgcgttagcgcgcacgcgcgcctcatgtgtcgtccccatcagcgccggcttccgtctataggccagatgcactgtcactctggcgaagtcgcagacccgattggccgggacggaggcgcgagaccgggttgcgggcggggccgaacgtggtataaaaggggcgggaggccaggctcgtgccgttttgcagacgccaccgccgaggaaaaccgtgtactattagccatggtcaaccccaccgtgttcttcgacattgccgtcgacggcgagcccttgggccgcgtctcctttgaggtaaggggcctggataccaagaagtgactgctcatctaatccataaagctatgttaacagattggagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgagttaagtgttgatgtaggctttattttaagcagtaatgggttacttctgaaacatcacttgtttgcttaattctacacagtacttagattttttttactttccagtcccaggaagtgtcaatgtttgttgagtggaatattgaaaatgtaggcagcaactgggcatggtggctcactgtctgtaatgtattacctgaggcagaagaccacctgagggtaggagtcaagatcagcctgggcaacatagtgagacgctgtctctacaaaaaataattagcctggcctggtggtgcatgcctagtcctagctgatctggaggctgacgtgggaggattgcttgagcctagagtgagctattatcatgccactgtacagcctgggtgttcacagatcttgtgtctccaaggtaggcagaggcaggaaaagcaaggagccagaattaagaggttgggtcagtctgcagtgagttcatgcatttagaggtgttcttcaagatgactaatgtcaaaaattgagacatctgttgcggttcttttttttttttttttttcccctggaatgcagtggcgtgatctcagctcactgcagcctccgcctcctgggttcaagtgattctagtgcctcagcctcctgagtagctgggataacgggcgtgtgccaccatgcccagctaatttttgtatttttagtatagatggggtttcatcattttgaccaggctggtctcaaactcttgacctcagctgatgcgcctgccttggcctcccaaactgctgagattacagatgtgagccaccgcaccctacctcattttctgtaacaaagctaagcttgaacactgttgatgttcttgagggaagcatattgggctttaggctgtaggtcaagtttatacatcttaattatggtggaattcctatgtagagtctaaaaagccaggtacttggtgctacagtcagtctccctgcagagggttaaggcgcagactacctgcagtgaggaggtactgcttgtagcatatagagcctctccctagctttggttatggaggctttgaggttttgcaaacctgaccaatttaagccataagatctggtcaaagggatacccttcccactaaggacttggtttctcaggaaattatatgtacagtgcttgctggcagttagatgtcaggacagtctaagctgagaaaaccccttctctgcccaccttaacagacctctagggttcttaacccagcaatcaagtttgcctatcctagaggtggcggatttgatcatttggtgtgttgggcaatttttgttttactgtctggttccttctgcgtgaattaccaccaccaccacttgtgcatctcagtcttgtgtgttgtctggttacgtattccctgggtgataccattcaatgtcttaatgtacttgtggctcagacctgagtgcaaggtggaaataaacatcaaacatcttttcatt

SEQ ID NO: 826 - DNA, 745 bp, Homo sapiens
gcagacgctgccgccaccaggagccctgtagtatcagccatagtcaatcccacggtgttcttcaacattgccatcaatggtgagcccttgggctgcatctcctttgagctgtttgcagacaagtttccaaagacagcagaaaaccttcgtgttctgggcatgggagagaaaggatttggttgtaagggctcccgctttcacagaattattccagggtttatgtgtcagggtggtgacttcacacgccataatggcactggtggcaagtccatctatggggagaaatttgatgatgagaacttcatcctaaagcatacaggtcctggcatcttgtccatggcaaatgctggacccaacacaaacggttcccagtttttcatctgcactgccaagagtgagtggttggatggcaagcatgtggtctttggcaagatgaaagaaggcataaatattgtggaggccacggggcgctttgggtccaggaatggaaagaccagcaagaaaatcaccattgctgactgtggacaacttgaataagtttgacttgtgttttatcttaaccaccagacccttccttttgtagctcaggagagcaccctccaccccatttgcttgcagtatcctagaatctttgtgctcttgctgcagttccctttgggttccatgttttccttgttccctatgcctagctgaattgaagagttgagttaagtttatgattatgaaattaaaactaaataactat

SEQ ID NO: 827 - DNA, 744 bp, Homo sapiens
cagacgctgctgccgaggaaaaccttgtattattaggcatggtcaaccccaccgtgttcttcgacattgccatcgacggcgagcccttgggccgcgtctccttttagctgtttgcagacaagttcccaaagacagcagaaaattttcgtgctctgagcactggagagaaaggatttagttataagggttcctgctttcacagaattattctagggtttatgtatcagggtcgtgacttcacacgccataatggcactggtggcaagtccatctatggggagaaatttgaagatgagaacttcatcctaaagcatacaggtcctggcatcttgtccatggcaaatgctggacccaacacaaatggttcccagtttttcatctgcactgccaagactgagtggttggatggcaagcatgtggtctttggcaaagtgaaagaaggcatgaatattatggaggccatggagcgctttgggtccaggaatggcaagaccagcaagaagatcaccattgctgactgtggacaactcgaataagtttgacttgtgttttatcttaaccaccagaccattccttctgtagttcaggagaacacccttccaccccatttgctcgcagtatcctagaatctttgtgctcttgctgcagttccatgttttccttgttccctcccatgcctagctggattgcagagttaagtttatgattatgaaataaaaaccaaataacaaaaaaacaagaaaa

SEQ ID NO: 828 - DNA, 765 bp, Homo sapiens
gtgctctgcggacgccaccgctgaggaaaaccgtgtactattagccatggtcaaccccaccatgttctttgaatttgccgtcgacagcgagcccttgggccatgtctccttcgagctgtttgcagacaagatcccaaagacagcagaaaattttcgtgctccgagcactggagagaaaggatttggttataaggtttcctgctttcacagaattattccagggtttatgtgtcagggtggtgactgtgaagtcaccataatggcactggtggcaagtccatctacacggagaaatttgaagatgagaacttcatcctaaagcatacaggtcctggcatcttgtccatggcaaatgctggacccaacacaaatggttcccagtttttcatctgcactgccaagagtgagtggttggatggcaagcacgtgctctttggcaaagtgaaagaaggcacgaatattgtggaggcatggagtgctttgggtccaggaatggcaagaccagcaagaagatcaccattgctgactgtggacaactcgaataagtttgacttgtgttttatcttaaccaccagaccattccttccgtagctcaggagagcacccctccaccccgtttgctcgcagtatcctagaatctttgtgctctcgctgcagttccctttgggttccatgttttccttgttccctcccatgcctagatggattgcagagttaagtttatgattatgaaataaaaactaaataacaacaacaaaaaagaaa

SEQ ID NO: 829 - DNA, 498 bp, Homo sapiens
atggtcaaccccaccgtgttcttcgacattgccgtcgacggcgagcctttgggccgcgtctccttcgagctgtttgcagacaaggttccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacaggtcctggcatcttgtccatggcaaatgctggacccaacacaaatggttcccagtttttcatctgcactgccaagactgagtggttggatggcaagcatgtggtctttggcaaagtgaaagaaggcatgaatattgtggaggccatggagcgctttgggtccaggaatggcaagaccagcaagaagatcaccattgctgactgtggacaactcgaataa

SEQ ID NO: 830 - DNA, 774 bp, Homo sapiens
acttggctttgcagacgccgccgccgaggaaaaccgtgtactattagccatggtcaaccccaccgtgttcttcgacattgccgtcgacggcgagcccttgggccgcgtctcctttgagctatttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacaggtcctggcatcttgtccatggcaaatgctggacccaacacaaatggatcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccaggtcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaaacaaaaaaaaagaagcaatta

SEQ ID NO: 831 - DNA, 755 bp, Homo sapiens
ttaaaaaaaacaaaaacaggctttgcagacgccacagccactggcaggagccctgtactatcagccatggttaaccccaccatgttctttgacatcgccgcgagcccttagactgtgtctccttcgagctgtttgcagacaaagtttcaaagacagcagaaaactttcgtgctctgagcactggagagaaaggatttggttgtaagggttcctgctttcacagaattattccagggtttatgtgtcagggtggtgacttcacatgccataatggcactggtggcaagtccatctactgggagaaatttgatgatgagaacttcatcctaaagcatacaggtcctggcatcttatccatggcaaatgctggacccaacacaaatggttcccagtttttcatctgcactgccaagactaagtggttggatggcaagcatgtggcctttggcaaggtgaaagaaggcatgaatattgtggaggccatggagggtccaggaatggcaagaccagcaagaagatcaccattgctgactgtggacaactctaataagtttgacttgtgttttatcttaacctccagaccattccttctgtaactcaggagagcatccttccacccaatttgctcgcagtatcctagaatctttgtgctctcactgcagttccctttgggtgccatgttttccttgttcccttccatgcccagctggattgcagagttaagtttatgattatgaaataaaaactaaatgcca

SEQ ID NO: 832 - DNA, 2561 bp, Homo sapiens
cagccaccgcgacggagcccgcaggcgggaacctgcctccgcgcgttagcgcgcacgcgcgcctcatgtgtcgtccccatcagcgccggcttccgtctataggccagatgcactgtcactctggcgaagtcgcagacccgattggccgggacggaggcgcgagaccgggttgcgggcggggccgaacgtggtataaaaggggcgggaggccaggctcgtgccgttttgcagacgccaccgccgaggaaaaccgtgtactattagccatggtcaaccccaccgtgttcttcgacattgccgtcgacggcgagcccttgggccgcgtctcctttgagtgacggcgctggcgggggaggcgctcttgagcccctcccgattgtccctctgcctagcaagcaagttgcgactggccacaaggcaggcctcttccgaccaagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgagttaagtgttgatgtaggctttattttaagcagtaatgggttacttctgaaacatcacttgtttgcttaattctacacagtacttagattttttttactttccagtcccaggaagtgtcaatgtttgttgagtggaatattgaaaatgtaggcagcaactgggcatggtggctcactgtctgtaatgtattacctgaggcagaagaccacctgagggtaggagtcaagatcagcctgggcaacatagtgagacgctgtctctacaaaaaataattagcctggcctggtggtgcatgcctagtcctagctgatctggaggctgacgtgggaggattgcttgagcctagagtgagctattatcatgccactgtacagcctgggtgttcacagatcttgtgtctccaaggtaggcagaggcaggaaaagcaaggagccagaattaagaggttgggtcagtctgcagtgagttcatgcatttagaggtgttcttcaagatgactaatgtcaaaaattgagacatctgttgcggttcttttttttttttttttttcccctggaatgcagtggcgtgatctcagctcactgcagcctccgcctcctgggttcaagtgattctagtgcctcagcctcctgagtagctgggataacgggcgtgtgccaccatgcccagctaatttttgtatttttagtatagatggggtttcatcattttgaccaggctggtctcaaactcttgacctcagctgatgcgcctgccttggcctcccaaactgctgagattacagatgtgagccaccgcaccctacctcattttctgtaacaaagctaagcttgaacactgttgatgttcttgagggaagcatattgggctttaggctgtaggtcaagtttatacatcttaattatggtggaattcctatgtagagtctaaaaagccaggtacttggtgctacagtcagtctccctgcagagggttaaggcgcagactacctgcagtgaggaggtactgcttgtagcatatagagcctctccctagctttggttatggaggctttgaggttttgcaaacctgaccaatttaagccataagatctggtcaaagggatacccttcccactaaggacttggtttctcaggaaattatatgtacagtgcttgctggcagttagatgtcaggacagtctaagctgagaaaaccccttctctgcccaccttaacagacctctagggttcttaacccagcaatcaagtttgcctatcctagaggtggcggatttgatcatttggtgtgttgggcaatttttgttttactgtctggttccttctgcgtgaattaccaccaccaccacttgtgcatctcagtcttgtgtgttgtctggttacgtattccctgggtgataccattcaatgtcttaatgtacttgtggctcagacctgagtgcaaggtggaaataaacatcaaacatcttttcatt

SEQ ID NO: 833 - DNA, 540 bp, Homo sapiens
atgagcggagtgtgggaaggaaggagccctgtagtatcagccatagtcaatcccacggtgttcttcaacattgccatcaatggtgagcccttgggctgcatctcctttgagctgtttgcagacaagtttccaaagacagcagaaaaccttcgtgttctgggcatgggagagaaaggatttggttgtaagggctcccgctttcacagaattattccagggtttatgtgtcagggtggtgacttcacacgccataatggcactggtggcaagtccatctatggggagaaatttgatgatgagaacttcatcctaaagcatacaggtcctggcatcttgtccatggcaaatgctggacccaacacaaacggttcccagtttttcatctgcactgccaagagtgagtggttggatggcaagcatgtggtctttggcaagatgaaagaaggcataaatattgtggaggccacggggcgctttgggtccaggaatggaaagaccagcaagaaaatcaccattgctgactgtggacaacttgaataa

SEQ ID NO: 834 - DNA, 665 bp, Homo sapiens
atgaggaggcagcccttagactgtgtctccttcgagctgtttgcagacaaagtttcaaagacagcagaaaactttcgtgctctgagcactggagagaaaggatttggttgtaagggttcctgctttcacagaattattccagggtttatgtgtcagggtggtgacttcacatgccataatggcactggtggcaagtccatctactgggagaaatttgatgatgagaacttcatcctaaagcatacaggtcctggcatcttatccatggcaaatgctggacccaacacaaatggttcccagtttttcatctgcactgccaagactaagtggttggatggcaagcatgtggcctttggcaaggtgaaagaaggcatgaatattgtggaggccatggagggtccaggaatggcaagaccagcaagaagatcaccattgctgactgtggacaactctaataagtttgacttgtgttttatcttaacctccagaccattccttctgtaactcaggagagcatccttccacccaatttgctcgcagtatcctagaatctttgtgctctcactgcagttccctttgggtgccatgttttccttgttcccttccatgcccagctggattgcagagttaagtttatgattatgaaataaaaactaaatgccaaa

SEQ ID NO: 835 - DNA, 719 bp, Homo sapiens
atgccaccgccgctgggagccctgtactatcagccatggtcaaccccactgttcttcaacattgctgacgaaggcaagcccttgggccgcgtctccttcaacctgtttgcagacaagattccaaagacagcagaaaactttcatgctctgagcactggcgagaaaggatttggttttaagggtttccgctttcacagaattattccagggtttatgtatcagggtggtgacttcacacccataatggcactggtggcaagtccatttacggggagaaatttggtgatgaaaacttcatcctaaagcatacaggtcctggcatcttgtccatggcaaatgctggacccaacacaaacggttcccagtttttcatctgcactgccaagactgagtggttggatggcaagcatgtggtctgtggcaaggcgaaagaaggcaagaatattgtggaggccatggagcgctgtggttccaggaatggcaagaccagcaagaagatcaccattgctgactgtgaacaactctaataagtttgacttgtgttttatcttaaccaccagaccattccttctgtagctcaggagagcacccctccaccccatttgctctcagtatcctagaatctttgtgctcttgctgcagttccctttgggttccatgttttccttgttcccttccgtgcctagctggattgcagtgttaagtttatgattatgaat

SEQ ID NO: 836 - DNA, 498 bp, Homo sapiens
atggtcaaccccaccgtgttcttccacatctctgtcgacggtgagtccttgggccgcatctcttttgagctgtttgcagacaagtttccaaagacagcagaaaacttttgtgctctgaatactggagagaaaggatttggttacaagggttgctgctttcacagaattattccagggtttatgtgtcatggtggtgacttcacacaccataatggcactggtggcaagtcaatctacggggagaaagttgatgatgacaacttcatcctgaagcatacaggtcctggcatattgtccatggcaaatgctggacccaacacaaatggttcccagtttttcatctgcactgccaagtctgagtggttggatagcaagcatgtggtcattggcaaggtgaaagaaggcatgaatattgtggaggccatggagcactttgggtccaggaatggcaagaccagcaagaaggtcaccattcctgactttggacaactcgaataa

SEQ ID NO: 837 - DNA, 477 bp, Homo sapiens
atgaggagttctaggactcacatatcaggcaccttcttccatgatcatctgtttgcagacaagttcccaaagacagcagaaaattttcgtgctctgagcactggagagaaaggatttagttataagggttcctgctttcacagaattattccagggtttatgtatcagggtcgtgacttcacacgccataatggcactggtggcaagtccatctatggggagaaatttgaagatgagaacttcatcctaaagcatacaggtcctggcatcttgtccatggcaaatgctggacccaacacaaatggttcccagtttttcatctgcactgccaagactgagtggttggatggcaagcatgtggtctttggcaaagtgaaagaaggcatgaatattatggaggccatggagcgctttgggtccaggaatggcaagaccagcaagaagatcaccattgctgactgtggacaactcgaataa

SEQ ID NO: 838 - DNA, 768 bp, Homo sapiens
gcggctttgcagatgacgccgccgaggaaaactgtgtactattagccatggtcaaccccaccgtgttcttcgacattgccgtcgatggcgagcccttgggccgcgtctcctttgagctgttagctgacaaggtcccaaagacagcagaaaattttcatgctctgagcactggagagaaaggatttggttataagggttcctgctttcacagaattattccagggtttatgtgtcagggtggtgacttcacacgccataatggcactagtggcaagtccatctatggggagaaatttgaagatgagaacttcatcctaaagcatacaggtcctggcatcttgtccatggcaaatgctggacccaacacaaatggctcccagtttttcatctgcactgccaagactgagtggttggatggcatgcatgtgatctgtggcaaagtgaaagaaggcatgaatattgtggaggtcatggagtgctttgggtccaggaatggcaagaccagcaagaagatcaccattgctgactgtggacaactcgaataagtttgacttgtgttttatcttaaccaccagaccattccttctgtagctcaggagagcacccctccatcccatttgctcgcagtatcctagaatctttgtgctctcgctgcagttccctttgggttccatgttttccttgttccctcccatgcctagctggattgcagagttaagtttatgattatgaaataaaaactaaataacaaaaaatatatatatataa

SEQ ID NO: 839 - DNA, 2616 bp, Homo sapiens
cagccaccgcgacggagcccgcaggcgggaacctgcctccgcgcgttagcgcgcacgcgcgcctcatgtgtcgtccccatcagcgccggcttccgtctataggccagatgcactgtcactctggcgaagtcgcagacccgattggccgggacggaggcgcgagaccgggttgcgggcggggccgaacgtggtataaaaggggcgggaggccaggctcgtgccgttttgcagacgccaccgccgaggaaaaccgtgtactattagccatggtcaaccccaccgtgttcttcgacattgccgtcgacggcgagcccttgggccgcgtctcctttgaggtaaggggcctggataccaagaagtgactgctcatctaatccataaagctatgttaacagattggaggtagtagcattttcattacaagtgactaaaagaacagctgtttacccctgatcgtgcagcagtgcttgctgttccttagaattttgccttctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgagttaagtgttgatgtaggctttattttaagcagtaatgggttacttctgaaacatcacttgtttgcttaattctacacagtacttagattttttttactttccagtcccaggaagtgtcaatgtttgttgagtggaatattgaaaatgtaggcagcaactgggcatggtggctcactgtctgtaatgtattacctgaggcagaagaccacctgagggtaggagtcaagatcagcctgggcaacatagtgagacgctgtctctacaaaaaataattagcctggcctggtggtgcatgcctagtcctagctgatctggaggctgacgtgggaggattgcttgagcctagagtgagctattatcatgccactgtacagcctgggtgttcacagatcttgtgtctccaaggtaggcagaggcaggaaaagcaaggagccagaattaagaggttgggtcagtctgcagtgagttcatgcatttagaggtgttcttcaagatgactaatgtcaaaaattgagacatctgttgcggttcttttttttttttttttttcccctggaatgcagtggcgtgatctcagctcactgcagcctccgcctcctgggttcaagtgattctagtgcctcagcctcctgagtagctgggataacgggcgtgtgccaccatgcccagctaatttttgtatttttagtatagatggggtttcatcattttgaccaggctggtctcaaactcttgacctcagctgatgcgcctgccttggcctcccaaactgctgagattacagatgtgagccaccgcaccctacctcattttctgtaacaaagctaagcttgaacactgttgatgttcttgagggaagcatattgggctttaggctgtaggtcaagtttatacatcttaattatggtggaattcctatgtagagtctaaaaagccaggtacttggtgctacagtcagtctccctgcagagggttaaggcgcagactacctgcagtgaggaggtactgcttgtagcatatagagcctctccctagctttggttatggaggctttgaggttttgcaaacctgaccaatttaagccataagatctggtcaaagggatacccttcccactaaggacttggtttctcaggaaattatatgtacagtgcttgctggcagttagatgtcaggacagtctaagctgagaaaaccccttctctgcccaccttaacagacctctagggttcttaacccagcaatcaagtttgcctatcctagaggtggcggatttgatcatttggtgtgttgggcaatttttgttttactgtctggttccttctgcgtgaattaccaccaccaccacttgtgcatctcagtcttgtgtgttgtctggttacgtattccctgggtgataccattcaatgtcttaatgtacttgtggctcagacctgagtgcaaggtggaaataaacatcaaacatcttttcatt

SEQ ID NO: 840 - DNA, 2459 bp, Homo sapiens
cagccaccgcgacggagcccgcaggcgggaacctgcctccgcgcgttagcgcgcacgcgcgcctcatgtgtcgtccccatcagcgccggcttccgtctataggccagatgcactgtcactctggcgaagtcgcagacccgattggccgggacggaggcgcgagaccgggttgcgggcggggccgaacgtggtataaaaggggcgggaggccaggctcgtgccgttttgcagacgccaccgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgagttaagtgttgatgtaggctttattttaagcagtaatgggttacttctgaaacatcacttgtttgcttaattctacacagtacttagattttttttactttccagtcccaggaagtgtcaatgtttgttgagtggaatattgaaaatgtaggcagcaactgggcatggtggctcactgtctgtaatgtattacctgaggcagaagaccacctgagggtaggagtcaagatcagcctgggcaacatagtgagacgctgtctctacaaaaaataattagcctggcctggtggtgcatgcctagtcctagctgatctggaggctgacgtgggaggattgcttgagcctagagtgagctattatcatgccactgtacagcctgggtgttcacagatcttgtgtctccaaggtaggcagaggcaggaaaagcaaggagccagaattaagaggttgggtcagtctgcagtgagttcatgcatttagaggtgttcttcaagatgactaatgtcaaaaattgagacatctgttgcggttcttttttttttttttttttcccctggaatgcagtggcgtgatctcagctcactgcagcctccgcctcctgggttcaagtgattctagtgcctcagcctcctgagtagctgggataacgggcgtgtgccaccatgcccagctaatttttgtatttttagtatagatggggtttcatcattttgaccaggctggtctcaaactcttgacctcagctgatgcgcctgccttggcctcccaaactgctgagattacagatgtgagccaccgcaccctacctcattttctgtaacaaagctaagcttgaacactgttgatgttcttgagggaagcatattgggctttaggctgtaggtcaagtttatacatcttaattatggtggaattcctatgtagagtctaaaaagccaggtacttggtgctacagtcagtctccctgcagagggttaaggcgcagactacctgcagtgaggaggtactgcttgtagcatatagagcctctccctagctttggttatggaggctttgaggttttgcaaacctgaccaatttaagccataagatctggtcaaagggatacccttcccactaaggacttggtttctcaggaaattatatgtacagtgcttgctggcagttagatgtcaggacagtctaagctgagaaaaccccttctctgcccaccttaacagacctctagggttcttaacccagcaatcaagtttgcctatcctagaggtggcggatttgatcatttggtgtgttgggcaatttttgttttactgtctggttccttctgcgtgaattaccaccaccaccacttgtgcatctcagtcttgtgtgttgtctggttacgtattccctgggtgataccattcaatgtcttaatgtacttgtggctcagacctgagtgcaaggtggaaataaacatcaaacatcttttcatt

SEQ ID NO: 841 - DNA, 2579 bp, Homo sapiens
cagccaccgcgacggagcccgcaggcgggaacctgcctccgcgcgttagcgcgcacgcgcgcctcatgtgtcgtccccatcagcgccggcttccgtctataggccagatgcactgtcactctggcgaagtcgcagacccgattggccgggacggaggcgcgagaccgggttgcgggcggggccgaacgtggtataaaaggggcgggaggccaggctcgtgccgttttgcagacgccaccgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtgactggatctcgctcttatctcccaggttggagtgcagtggtgccatctcagctcactgcaacctcctcccgggttcaagcaattcttctgcctcagcctctcaagtagctggaactacaggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgagttaagtgttgatgtaggctttattttaagcagtaatgggttacttctgaaacatcacttgtttgcttaattctacacagtacttagattttttttactttccagtcccaggaagtgtcaatgtttgttgagtggaatattgaaaatgtaggcagcaactgggcatggtggctcactgtctgtaatgtattacctgaggcagaagaccacctgagggtaggagtcaagatcagcctgggcaacatagtgagacgctgtctctacaaaaaataattagcctggcctggtggtgcatgcctagtcctagctgatctggaggctgacgtgggaggattgcttgagcctagagtgagctattatcatgccactgtacagcctgggtgttcacagatcttgtgtctccaaggtaggcagaggcaggaaaagcaaggagccagaattaagaggttgggtcagtctgcagtgagttcatgcatttagaggtgttcttcaagatgactaatgtcaaaaattgagacatctgttgcggttcttttttttttttttttttcccctggaatgcagtggcgtgatctcagctcactgcagcctccgcctcctgggttcaagtgattctagtgcctcagcctcctgagtagctgggataacgggcgtgtgccaccatgcccagctaatttttgtatttttagtatagatggggtttcatcattttgaccaggctggtctcaaactcttgacctcagctgatgcgcctgccttggcctcccaaactgctgagattacagatgtgagccaccgcaccctacctcattttctgtaacaaagctaagcttgaacactgttgatgttcttgagggaagcatattgggctttaggctgtaggtcaagtttatacatcttaattatggtggaattcctatgtagagtctaaaaagccaggtacttggtgctacagtcagtctccctgcagagggttaaggcgcagactacctgcagtgaggaggtactgcttgtagcatatagagcctctccctagctttggttatggaggctttgaggttttgcaaacctgaccaatttaagccataagatctggtcaaagggatacccttcccactaaggacttggtttctcaggaaattatatgtacagtgcttgctggcagttagatgtcaggacagtctaagctgagaaaaccccttctctgcccaccttaacagacctctagggttcttaacccagcaatcaagtttgcctatcctagaggtggcggatttgatcatttggtgtgttgggcaatttttgttttactgtctggttccttctgcgtgaattaccaccaccaccacttgtgcatctcagtcttgtgtgttgtctggttacgtattccctgggtgataccattcaatgtcttaatgtacttgtggctcagacctgagtgcaaggtggaaataaacatcaaacatcttttcatt

SEQ ID NO: 842 - DNA, 4394 bp, Homo sapiens
tcccttctcccctctgggtccagcctcagactgaggcttggagacaggagcattccactcgccacttcggcgcgcccccatgccctcttgtgcgcgtgcgcagaggcggaccgcaaggctagggcgtgagggaagggcgggcgtacgcccttgcgtgcgtctcaggcagcgcgcacgccggcgtgagagggcacggggaaaaggtggctctggccggggtggctcggtttcctggggctatgtaactgagctcgtcgacttaggggtccttcttcgctgccctcgccgcgtgctagcagggagtttccgctcgggagagagactgtcctcacgcccgctgcgcctcctcgacggcagagcaggcttgctcgcccgtgggagcgtcccggccgagaagccctgaggggggaggggaggccattttgtcccgaccgactccccggaaccgggcggagcggctgggagaggctgcggagccgcggtcgccgccctcggaggcactggacgccgccactgtcggggcttcctcaaagctgttcgtaggtcgcccgcgccgtctcgagcctttttcccacgcttccccggtcctccggcctgagaacgcccgagtgaggagttggccgtagtgagagggaccgatcccttggggccgccggcggcgagagcccgagccgctcctcccaatggcgaagaagacgtacgacctgcttttcaagctgctcctgatcggggattccggagtggggaagacctgcgtcctttttcgtttttcggatgatgccttcaatactacctttatttccaccataggaatagacttcaagatcaaaacagttgaattacaaggaaagaagatcaagctacagatatgggatacagcaggccaggagcgatttcacaccatcacaacctcctactacagaggcgcaatgggtatcatgctagtatatgacatcaccaatggtaaaagttttgaaaacatcagcaaatggcttagaaacatagatgagcatgccaatgaagatgtggaaagaatgttactaggaaacaagtgtgatatggacgacaaaagagttgtacctaaaggaaaaggagaacagattgcaagggagcatggtattaggttttttgagactagtgcaaaagcaaatataaacatcgaaaaggcgttcctcacgttagctgaagatatccttcgaaagacccctgtaaaagagcccaacagtgaaaatgtagatatcagcagtggaggaggcgtgacaggctggaagagcaaatgctgctgagcattctcctgttccatcagttgccatccactaccccgttttctcttcttgctgcaaaataaaccactctgtccatttttaactctaaacagatatttttgtttctcatcttaactatccaagccacctattttatttgttctttcatctgtgactgcttgctgactttatcataattttcttcaaacaaaaaaatgtatagaaaaatcatgtctgtgacttcatttttaaatgtacttgctcagctcaactgcatttcagttgtattatagtccagttcttatcaacattaaaacctatagcaatcatttcaaatctattctgcaaattgtataagaataaagttagaattaacaattttattttgtacaacagtggaattttctgtcatggataatgtgcttgagtccctataatctatagacatgtgatagcaaaagaaacaaacaaaagccaggaaaacactcattttcgccttgaatatgtaaatgggattaattttgtcctgtgccttatgtggaaaggaacttctttggttttccttttttgttctggtggaagcatgtgcaggagacatatcatccaaacataaaccattaaaatgtttgtggtttgcttggctgtaattttcaaagtagttaattgaggacaaagggtaatgcagaagtgatagctttggtttgctgagtcttgttttaagtggccttgatatttaaaactattcctgccaccatttcttctccttggccacttcttccttgcgtctccctgcatgctgctttatttgcttctccctccccaaccacctcatggtatatttaagagtgaaagggacaaactagtaggtttgtcaagtttaatataaagcactgatgtaacttgctaggtaaacggaaagataagttctaactgcctactatccaatgtcagttaattggtgtcttcccccctcatttgctctcttccctaaaatgtgtcccagatgccttcatttgctgttttacttctatgttctgcttttcctcctctctttgttcccttcctgtctatccattgagtttatgaaatggaagagttaactgcatgcactagtgtttggagggtgttgtggtttgtctttctaattaggtgtatagcctattcactttcctagaataaatctcttaacctaaatttgagtagtctgcattttggcaactcctctagcagcttggtagcctagtacaggttgtttttttaaaaaaggaaaagcaggaaggaggagtgaattttattaacatgtttgccaaatgtattgagatttggcctctgaagaacactttttcagtgttaagtttctttaccttaagattcagaaatactttagaatattattaattttaagtcctgtctttacatccttttggaaaacttgtattaccatgggtttggaaaaaggacaacgaaaggcttttcatgtaaagataagatctttagctatctctaaccctgtccttttttcactgcattttttctagttttgcttcattgcttatcattaggatagggtaagtgaagtttgctatgctgctagcatcctaagatgatacctttgttgaaagaattgtgaatagcatgattcatttctagcagaggctgagtttaggacagcagcttccattgagaagtctttctgtgtcgtgaatagcattttaatgacctcttggctcacataagcaaacaacatagggacgtatctgctatgaaaatccacaaatttttcagatagtgccctaaaaacaattttatatgcctcactggttgttattcttaggttattcccacacttgactttatcattgtttactactagtaaaaagcagcattgccaaataatccctaattttccactaaaaatataatgaaatgatgttaagctttttgaaaagtttaggttaaacctactgttgttagattaatgtatttgttgcttccctttatctggaatgtggcattagcttttttattttaaccctctttaattcttattcaattccatgacttaaggttggagagctaaacactgggatttttggataacagactgacagttttgcataattataatcggcattgtacatagaaaggatatggctaccttttgttaaatctgcactttctaaatatcaaaaaagggaaatgaagtataaatcaatttttgtataatctgtttgaaacatgagttttatttgcttaatattagggctttgccccttttctgtaagtctcttgggatcctgtgtagaagctgttctcattaaacaccaaacagttaagtccattctctggtactagctacaaattcggtttcatattctacttaacaatttaaataaactgaaatatttctagatggtctacttctgttcatataaaaacaaaacttgatttccagctgtgtggtttggttttcatttatttatggaattggaagattacttctgaaaaaaatgtggaatcgcaaactcaaagagttgacaaaaatgggaaatcactgtcaacctatggaaaactggaaaggcaatttcaagaactgtctttgctgagaaactacattaaaaaatagaattatctctgggatcctaaagcggaatcatccttgtgccaaaataggagatgccacgatcctaatcacacctggcttacactagttggatgtgcctaaggccactacagctgaggtcacctgattcctcagggggaccaagctgggctcctcatactggagggtaaatccttgttttagcagcagctggcctcttactaagaaacaaagtattggccaggtgcggtggctcatgcctgtaatcccagcactttgggaggtcaaggcggacggatcacgaagtcaggagatggagaccatcctggctaacgtggtaaaaccccgtctctattaaaaatacaaaaaaattagccgggcgtggtggcgggcgcctgtagtcccagctactcgggaggctgaggcaggagaatggcgtgaacccgggaggaggaggaggaggctgcagtgagccgagatagcgccactgcactccagcctgggcgacagagcaagactccgtctca

SEQ ID NO: 843 - DNA, 3982 bp, Homo sapiens
tcccttctcccctctgggtccagcctcagactgaggcttggagacaggagcattccactcgccacttcggcgcgcccccatgccctcttgtgcgcgtgcgcagaggcggaccgcaaggctagggcgtgagggaagggcgggcgtacgcccttgcgtgcgtctcaggcagcgcgcacgccggcgtgagagggcacggggaaaaggtggctctggccggggtggctcggtttcctggggctatgtaactgagctcgtcgacttaggggtccttcttcgctgccctcgccgcgtgctagcagggagtttccgctcgggagagagactgtcctcacgcccgctgcgcctcctcgacggcagagcaggcttgctcgcccgtgggagcgtcccggccgagaagccctgaggggggaggggaggccattttgtcccgaccgactccccggaaccgggcggagcggctgggagaggctgcggagccgcggtcgccgccctcggaggcactggacgccgccactgtcggggcttcctcaaagctgttcgtaggtcgcccgcgccgtctcgagcctttttcccacgcttccccggtcctccggcctgagaacgcccgagtgaggagttggccgtagtgagagggaccgatcccttggggccgccggcggcgagagcccgagccgctcctcccaatggcgaagaagacgtacgacctgcttttcaagctgctcctgatcggggattccggagtggggaagacctgcgtcctttttcgtttttcggatgatgccttcaatactacctttatttccaccataggaatagacttcaagatcaaaacagttgaattacaaggaaagaagatcaagctacagatatgggatacagcaggccaggagcgatttcacaccatcacaacctcctactacagaggcgcaatgggtatcatgctagtatatgacatcaccaatggtaaaagttttgaaaacatcagcaaatggcttagaaacatagatgagcatgccaatgaagatgtggaaagaatgttactaggaaacaagtgtgatatggacgacaaaagagttgtacctaaaggaaaaggagaacagattgcaagggagcatggtattaggttttttgagactagtgcaaaagcaaatataaacatcgaaaaggcgttcctcacgttagctgaagatatccttcgaaagacccctgtaaaagagcccaacagtgaaaatgtagatatcagcagtggaggaggcgtgacaggctggaagagcaaatgctgctgagcattctcctgttccatcagttgccatccactaccccgttttctcttcttgctgcaaaataaaccactctgtccatttttaactctaaacagatatttttgtttctcatcttaactatccaagccacctattttatttgttctttcatctgtgactgcttgctgactttatcataattttcttcaaacaaaaaaatgtatagaaaaatcatgtctgtgacttcatttttaaatgtacttgctcagctcaactgcatttcagttgtattatagtccagttcttatcaacattaaaacctatagcaatcatttcaaatctattctgcaaattgtataagaataaagttagaattaacaattttattttgtacaacagtggaattttctgtcatggataatgtgcttgagtccctataatctatagacatatcatccaaacataaaccattaaaatgtttgtggtttgcttggctgtaattttcaaagtagttaattgaggacaaagggtaatgcagaagtgatagctttggtttgctgagtcttgttttaagtggccttgatatttaaaactattcctgccaccatttcttctccttggccacttcttccttgcgtctccctgcatgctgctttatttgcttctccctccccaaccacctcatggtatatttaagagtgaaagggacaaactagtaggtttgtcaagtttaatataaagcactgatgtaacttgctaggtaaacggaaagataagttctaactgcctactatccaatgtcagttaattggtgtcttcccccctcatttgctctcttccctaaaatgtgtcccagatgccttcatttgctgttttacttctatgttctgcttttcctcctctctttgttcccttcctgtctatccattgagtttatgaaatggaagagttaactgcatgcactagtgtttggagggtgttgtggtttgtctttctaattaggtgtatagcctattcactttcctagaataaatctcttaacctaaatttgagtagtctgcattttggcaactcctctagcagcttggtagcctagtacaggttgtttttttaaaaaaggaaaagcaggaaggaggagtgaattttattaacatgtttgccaaatgtattgagatttggcctctgaagaacactttttcagtgttaagtttctttaccttaagattcagaaatactttagaatattattaattttaagtcctgtctttacatccttttggaaaacttgtattaccatgggtttggaaaaaggacaacgaaaggcttttcatgtaaagataagatctttagctatctctaaccctgtccttttttcactgcattttttctagttttgcttcattgcttatcattaggatagggtaagtgaagtttgctatgctgctagcatcctaagatgatacctttgttgaaagaattgtgaatagcatgattcatttctagcagaggctgagtttaggacagcagcttccattgagaagtctttctgtgtcgtgaatagcattttaatgacctcttggctcacataagcaaacaacatagggacgtatctgctatgaaaatccacaaatttttcagatagtgccctaaaaacaattttatatgcctcactggttgttattcttaggttattcccacacttgactttatcattgtttactactagtaaaaagcagcattgccaaataatccctaattttccactaaaaatataatgaaatgatgttaagctttttgaaaagtttaggttaaacctactgttgttagattaatgtatttgttgcttccctttatctggaatgtggcattagcttttttattttaaccctctttaattcttattcaattccatgacttaaggttggagagctaaacactgggatttttggataacagactgacagttttgcataattataatcggcattgtacatagaaaggatatggctaccttttgttaaatctgcactttctaaatatcaaaaaagggaaatgaagtataaatcaatttttgtataatctgtttgaaacatgagttttatttgcttaatattagggctttgccccttttctgtaagtctcttgggatcctgtgtagaagctgttctcattaaacaccaaacagttaagtccattctctggtactagctacaaattcggtttcatattctacttaacaatttaaataaactgaaatatttctagatggtctacttctgttcatataaaaacaaaacttgatttccagctgtgtggtttggttttcatttatttatggaattggaagattacttctgaaaaaaatgtggaatcgcaaactcaaagagttgacaaaaatgggaaatcactgtcaacctatggaaaactggaaaggcaatttcaagaactgtctttgctgagaaactacattaaaaaatagaattatctctgggatcctaaagcggaatcatccttgtgccaaaataggagatgccacgatcctaatcacacctggcttacactagttggatgtgcctaaggccactacagctgaggtcacctgattcctcagggggaccaagctgggctcctcatactggagggtaaatccttgttttagcagcagctggcctcttactaagaaacaaagtattggccaggtgcggtggctcatgcctgta

SEQ ID NO: 844 - DNA, 603 bp, Homo sapiens
atggcgaagaagacgtacgacctgcttttcaagctgctcctgatcggggattccggagtggggaagacctgcgtcctttttcgtttttcggatgatgccttcaatactacctttatttccaccataggaatagacttcaagatcaaaacagttgaattacaaggaaagaagatcaagctacagatatgggatacagcaggccaggagcgatttcacaccatcacaacctcctactacagaggcgcaatgggtatcatgctagtatatgacatcaccaatggtaaaagttttgaaaacatcagcaaatggcttagaaacatagatgagcatgccaatgaagatgtggaaagaatgttactaggaaacaagtgtgatatggacgacaaaagagttgtacctaaaggaaaaggagaacagattgcaagggagcatggtattaggttttttgagactagtgcaaaagcaaatataaacatcgaaaaggcgttcctcacgttagctgaagatatccttcgaaagacccctgtaaaagagcccaacagtgaaaatgtagatatcagcagtggaggaggcgtgacaggctggaagagcaaatgctgctga

SEQ ID NO: 845 - DNA, 2158 bp, Homo sapiens
acacagggtttcctcatgttgcccaggctggtctcggacacttgaattcaagcaatctgccggccccgccgggtgtgccgcatgagggcgcgggccgcccaaggaccgcgagtggggccgcgagtgctgagcccggcgcgcccgagccgctcctcctcccggcctgctccctgggcggagccggggcagtgcggctctgggctggccgaaggggtggcgctgcgatcccgcagggcagcgacgcgactctggtgcgggccgtcttcttccccccgagctgggcgtgcgcggccgcaatgaactgggagctgctgctgtggctgctggtgctgtgcgcgctgctcctgctcttggtgcagctgctgcgcttcctgagggctgacggcgacctgacgctactatgggccgagtggcagggacgacgcccagaatgggagctgactgatatggtggtgtgggtgactggagcctcgagtggaattggtgaggagctggcttaccagttgtctaaactaggagtttctcttgtgctgtcagccagaagagtgcatgagctggaaagggtgaaaagaagatgcctagagaatggcaatttaaaagaaaaagatatacttgttttgccccttgacctgaccgacactggttcccatgaagcggctaccaaagctgttctccaggagtttggtagaatcgacattctggtcaacaatggtggaatgtcccagcgttctctgtgcatggataccagcttggatgtctacagaaagctaatagagcttaactacttagggacggtgtccttgacaaaatgtgttctgcctcacatgatcgagaggaagcaaggaaagattgttactgtgaatagcatcctgggtatcatatctgtacctctttccattggatactgtgctagcaagcatgctctccggggtttttttaatggccttcgaacagaacttgccacatacccaggtataatagtttctaacatttgcccaggacctgtgcaatcaaatattgtggagaattccctagctggagaagtcacaaagactataggcaataatggagaccagtcccacaagatgacaaccagtcgttgtgtgcggctgatgttaatcagcatggccaatgatttgaaagaagtttggatctcagaacaacctttcttgttagtaacatatttgtggcaatacatgccaacctgggcctggtggataaccaacaagatggggaagaaaaggattgagaactttaagagtggtgtggatgcagactcttcttattttaaaatctttaagacaaaacatgactgaaaagagcacctgtacttttcaagccactggagggagaaatggaaaacatgaaaacagcaatcttcttatgcttctgaataatcaaagactaatttgtgattttactttttaatagatatgactttgcttccaacatggaatgaaataaaaaataaataataaaagattgccatgaatcttgcaaaaaaggtattaactcatactatattcttggataaaataaccttttaaaatactttagcacatatgcttaaaatctaagttaacagatttgtcttagtccatttgtgctgctataacaaaataccacagatttggtaatttataaacaacagaaatctgtttttcctggctcttgaggctgggaattccaagaccaatgcaccagcagaattagtgtctggtgaaggctgatctctgcttccaagatggcacctcattgctgcatcctccacagtggaggaatgtatgtcctcacatggtggaagggacagaagggaaagaggagcaaaatgctttcaaaagagcatttaatctcattcattactcagtcacctcttaaaggccacatcctttaatactgttgctttggggattaagtttcgacatgaattttggaggggacaaaaacatccaaaccatagcaacataaatgtatagaatatttcacacaaagcagagtgctgggtaatgaccagatataaagaagtatttgaaatgaccttacctccaagatgcttatactcttagaaaagttgacaggtacagatggctgtaatttgaagcagcaggtaggattcattgcacctattattcattaaacacctgttgtatgtcttcta

SEQ ID NO: 846 - DNA, 1236 bp, Homo sapiens
ccgtcttcttccccccgagctgggcgtgcgcggccgcaatgaactgggagctgctgctgtggctgctggtgctgtgcgcgctgctcctgctcttggtgcagctgctgcgcttcctgagggctgacggcgacctgacgctactatgggccgagtggcagggacgacgcccagaatgggagctgactgatatggtggtgtgggtgactggagcctcgagtggaattggtgaggagctggcttaccagttgtctaaactaggagtttctcttgtgctgtcagccagaagagtgcatgagctggaaagggtgaaaagaagatgcctagagaatggcaatttaaaagaaaaagatatacttgttttgccccttgacctgaccgacactggttcccatgaagcggctaccaaagctgttctccaggagtttggtagaatcgacattctggtcaacaatggtggaatgtcccagcgttctctgtgcatggataccagcttggatgtctacagaaagctaatagagcttaactacttagggacggtgtccttgacaaaatgtgttctgcctcacatgatcgagaggaagcaaggaaagattgttactgtgaatagcatcctgggtatcatatctgtacctctttccattggatactgtgctagcaagcatgctctccggggtttttttaatggccttcgaacagaacttgccacatacccaggtataatagtttctaacatttgcccaggacctgtgcaatcaaatattgtggagaattccctagctggagaagtcacaaagactataggcaataatggagaccagtcccacaagatgacaaccagtcgttgtgtgcggctgatgttaatcagcatggccaatgatttgaaagaagtttggatctcagaacaacctttcttgttagtaacatatttgtggcaatacatgccaacctgggcctggtggataaccaacaagatggggaagaaaaggattgagaactttaagagtggtgtggatgcagactcttcttattttaaaatctttaagacaaaacatgactgaaaagagcacctgtacttttcaagccactggagggagaaatggaaaacatgaaaacagcaatcttcttatgcttctgaataatcaaagactaatttgtgattttactttttaatagatatgactttgcttccaacatggaatgaaataaaaaaaaaaaaaaaaaaaaaaaaaaaaaaaa

SEQ ID NO: 847 - DNA, 2318 bp, Homo sapiens
gcaatccaagactgcttagggttcggaattacaaaaccaaattccctgctaaggctaaagttgatctgaacaaaagtaagggcaaggcaaagagaatagacattagacagggacctgaaaggatccagaaatgggactttacatcccacagaggaaacagacacagggtttcctcatgttgcccaggctggtctcggacacttgaattcaagcaatctgccggccccgccgggtgtgccgcatgagggcgcgggccgcccaaggaccgcgagtggggccgcgagtgctgagcccggcgcgcccgagccgctcctcctcccggcctgctccctgggcggagccggggcagtgcggctctgggctggccgaaggggtggcgctgcgatcccgcagggcagcgacgcgactctggtgcgggccgtcttcttccccccgagctgggcgtgcgcggccgcaatgaactgggagctgctgctgtggctgctggtgctgtgcgcgctgctcctgctcttggtgcagctgctgcgcttcctgagggctgacggcgacctgacgctactatgggccgagtggcagggacgacgcccagaatgggagctgactgatatggtggtgtgggtgactggagcctcgagtggaattggtgaggagctggcttaccagttgtctaaactaggagtttctcttgtgctgtcagccagaagagtgcatgagctggaaagggtgaaaagaagatgcctagagaatggcaatttaaaagaaaaagatatacttgttttgccccttgacctgaccgacactggttcccatgaagcggctaccaaagctgttctccaggagtttggtagaatcgacattctggtcaacaatggtggaatgtcccagcgttctctgtgcatggataccagcttggatgtctacagaaagctaatagagcttaactacttagggacggtgtccttgacaaaatgtgttctgcctcacatgatcgagaggaagcaaggaaagattgttactgtgaatagcatcctgggtatcatatctgtacctctttccattggatactgtgctagcaagcatgctctccggggtttttttaatggccttcgaacagaacttgccacatacccaggtataatagtttctaacatttgcccaggacctgtgcaatcaaatattgtggagaattccctagctggagaagtcacaaagactataggcaataatggagaccagtcccacaagatgacaaccagtcgttgtgtgcggctgatgttaatcagcatggccaatgatttgaaagaagtttggatctcagaacaacctttcttgttagtaacatatttgtggcaatacatgccaacctgggcctggtggataaccaacaagatggggaagaaaaggattgagaactttaagagtggtgtggatgcagactcttcttattttaaaatctttaagacaaaacatgactgaaaagagcacctgtacttttcaagccactggagggagaaatggaaaacatgaaaacagcaatcttcttatgcttctgaataatcaaagactaatttgtgattttactttttaatagatatgactttgcttccaacatggaatgaaataaaaaataaataataaaagattgccatgaatcttgcaaaaaaggtattaactcatactatattcttggataaaataaccttttaaaatactttagcacatatgcttaaaatctaagttaacagatttgtcttagtccatttgtgctgctataacaaaataccacagatttggtaatttataaacaacagaaatctgtttttcctggctcttgaggctgggaattccaagaccaatgcaccagcagaattagtgtctggtgaaggctgatctctgcttccaagatggcacctcattgctgcatcctccacagtggaggaatgtatgtcctcacatggtggaagggacagaagggaaagaggagcaaaatgctttcaaaagagcatttaatctcattcattactcagtcacctcttaaaggccacatcctttaatactgttgctttggggattaagtttcgacatgaattttggaggggacaaaaacatccaaaccatagcaacataaatgtatagaatatttcacacaaagcagagtgctgggtaatgaccagatataaagaagtatttgaaatgaccttacctccaagatgcttatactcttagaaaagttgacaggtacagatggctgtaatttgaagcagcaggtaggattcattgcacctattattcattaaacacctgttgtatgtcttcta

SEQ ID NO: 848 - DNA, 4604 bp, Homo sapiens
ggctgcctccccctctcagccggcagcacattccgtcgccttgccgccgcccggccccacagttgtctttgccggagctgcagtcgcgctggggttagggcgggggggcgggcggggagaggagaaggccgcggcggaggcaggtgagaggaggaaggaagcggcggcgcggcgggcacagcagctcaggcggcggcccggttcctgggagtgtcggtgcggcgcgttggttggggcggatcccgcggggcccgggcgggggaaggagtcaccggcccggccatggcggacaacgagaaactggacaaccaacggctcaagaatttcaagaacaaaggccgcgacttggagactatgagaagacaacgaaatgaagttgtagttgaattaaggaagaataaaagagatgaacatctcttaaagagaaggaatgtaccacatgaagatatctgtgaagactctgatatagatggtgattatagagtgcaaaatacctctctagaagctattgttcaaaatgcttcaagtgataaccaaggaattcaattaagtgcagttcaagctgctaggaagcttttgtccagtgatcgaaatccaccaattgatgacttaataaaatctggaatattgcccattttagtccattgtcttgaaagagatgacaatccttctttacagtttgaagctgcatgggctttgacaaacattgcatctggaacttctgaacaaactcaagcagtagttcagtccaatgctgtgccacttttcctgaggcttctccattcaccccatcagaatgtctgtgagcaagcagtgtgggcattgggaaatatcataggtgatgggccccagtgtagagattatgtcataagtcttggagttgtgaaacctttactttccttcataagtccatctattcctataacattcttaagaaatgttacttgggttatggtcaacttatgtcgccacaaagacccaccaccaccaatggaaaccattcaggagattcttccagccctttgtgttttaattcatcacacagatgtaaatatactggtagacacagtctgggccctctcttaccttactgatgctggcaatgaacaaatacagatggtaatagactctggaatagttcctcatttggttcctctgctcagccaccaggaagttaaagttcagactgctgcacttagagctgtgggcaacattgttactggaactgatgagcaaacacaagtagttttgaactgtgatgctctttcacacttcccagcactcctgacacatcccaaagagaaaattaataaagaagcagtgtggttcctctccaacatcactgcaggaaatcagcagcaggtacaggcagtaattgatgccaatcttgtaccaatgataatacaccttttggataagggggattttggcactcaaaaagaagctgcttgggccataagtaacttaacaattagtggaaggaaagatcaagtggcttaccttatccaacaaaatgttatcccacctttttgcaacttgctgactgtaaaagatgcacaagttgtgcaagtagtactcgatggactaagtaatatattaaaaatggctgaagatgaggcagaaaccataggcaatcttatagaagaatgtggagggctggagaaaattgaacaacttcaaaatcatgaaaatgaagacatctacaaattggcctatgagatcattgatcagttcttctcttcagatgatattgatgaagaccctagccttgttccagaggcaattcaaggcggaacatttggtttcaattcatctgccaatgtaccaacagaagggttccagttttagaaagatgttgtggaagttaggtacaatgcagcactgagatatatatatatatatgtgtgtgtgtatatatatatatatatacatatatataaaaaggtttgatccatcaagcttggctcatgggatctgctgctgcattaaatcgggaaagaaaatgtgaagatttcatttggaatcacagaaaatgcccaaatgaggtcaagatggcgagtgggtgcgagtgagaatgagtggcaaaatgtaatgaaaactttacatgaatgcttatttaggttgttcaaagtaaaaagggctacaggtcacagatcgtcagtgcctgagaaagaacattgacttactctatatcaattgaggggaaagtgcagtaccgtcatcttcaagccttgtaagcataaaagagaataggctgcccatataagtcaaaggaaaatgagcccaggccttgctatgaagcagtgtgtgaatggacaatgttgaatgaatgtctggctcagtgatggagagccaggttcatctttgaaatctagggctcttcactcatgaagcagactcctagtcctggagtgactgtgtacgagagcgtggttgtggtgctgtatgtgaacgcatgcaagcttgattcaccttcagggggctgataacctagtaaatcatcaaaatgagatcataagtgttaatgtacactggacatgaaaacaaagactggtttagcagcagacattggtttactctgcagcctgtgttttctgtttccccctttcccacctccttccccccacccaatccttttttttttcttttttgcttttcttttctttttttttagtttttatttactttacctagtatgcctttttttagttgcttctcaagtcagaaaacttttcaggaaggtttccctgtgcatttgcaccagatgaatgtttgatgctatgaaaagctttccatatcatcaaaactaatttgtgtagatttttgcatgaaaaaaatcataaatttccctcaaaatagactgtgttgcagtacacaagttgccataatagtataaaacagtaaaatgtgcttaaaaggccatccttttcattttcagagataacataaagatctttgcatgaggtaaatctacagcatagttcatttttagattttgttgagtcctgtaaagaagaagaagaaaaaagtttcagttgtggtagaataccgtgctgtgtttaaatgttacttgttttcaaactttgttttctatgaaaatgatatggaaacttctaaaatggaatttggtgcatatgtactgctgaataaagaccgatgaagaggtttgagtagatgtacaaatcaagtaatggtttgaacacctttaataatatgcctaatctgttcaattgttttagaatctttttatcttagatgtaggcagccatgaacaatctattttgagccactttagggagaaaactttgtatttttaaaacttgcataaaagttatgcaagtggtttttataaattggaataatacctcagttttgaggttatgcacactaaattaaatgtgacataaattaatttgtacaaaaagaactctttataaggtggctcattgtaggaaatcctgtgccttcccctttgagcacaagtgttgcatgaacaacagtttgctataagaaacataccagattagccaccattagcatctatatctactttgtgtttaaaaatcaactggtaattctgaaacactgtagaatggataaaaattattttgtgatcataactctttgttgaactagagtatttttgcagcattccttgtcatcagaaacatggttaaagtttaaaactagaagcagcagaaaactagcttgtaaaatttatccaagtagagtgcaggctaggctgtcttggggaaataaacattaaaacttaaagcaatgttttacatggggtgtgtgtgtgtggtgtgtggatttttttttttttataaagttagagtataattcaatggcttacattagcttcctgtctttttacctagaaccagcataataagaaatttctttggttctgtcatttcagtatggacatattaatattttagcccactgagtttgtccagttgacaccatcagtgcttcagttttctctctatccaaagcaaggttttaactttccttcattctccagtaaaacagaccgagacaacttgaactatattttgagtattgctatatcttcaacatatagctccaaatgatggattgtatacaaagcatagtacagaaggtttcagtaattggaaggtgaacacagcaatgctttacataatttgtgttttttagtaaaaaatattggattcaaagtaagccaatgagcttgtatacaaattttatatacaaattattgtatagaacagtgatatggaaaataggtaagggtgatattaatatctctgggtataaggactaccttatcgtttaaatattttatttccatctatagcctaatatagaacattgattttctagtagaaattctgggaagggcttttctgtctctgaaattgattcagtacagttgacagttcatcacggttacctggttaaacactttttttttttttttaattctccagtgatctaggaaattgtttcatttttaacacaggcttatttctgatggggatgggggcatagaataatatgcctaataagctaaacgttcttaacgtttcatgtcttaaactgtctttttgaacatt

SEQ ID NO: 849 - DNA, 3411 bp, Homo sapiens
ggctgcctccccctctcagccggcagcacattccgtcgccttgccgccgcccggccccacagttgtctttgccggagctgcagtcgcgctggggttagggcgggggggcgggcggggagaggagaaggccgcggcggaggcaggtgagaggaggaaggaagcggcggcgcggcgggcacagcagctcaggcggcggcccggttcctgggagtgtcggtgcggcgcgttggttggggcggatcccgcggggcccgggcgggggaaggagtcaccggcccggccatggcggacaacgagaaactggacaaccaacggctcaagaatttcaagaacaaaggccgcgacttggagactatgagaagacaacgaaatgaagttgtagttgaattaaggaagaataaaagagatgaacatctcttaaagagaaggaatgtaccacatgaagatatctgtgaagactctgatatagatggtgattatagagtgcaaaatacctctctagaagctattgttcaaaatgcttcaagtgataaccaaggaattcaattaagtgcagttcaagctgctaggaagcttttgtccagtgatcgaaatccaccaattgatgacttaataaaatctggaatattgcccattttagtccattgtcttgaaagagatgacaatccttctttacagtttgaagctgcatgggctttgacaaacattgcatctggaacttctgaacaaactcaagcagtagttcagtccaatgctgtgccacttttcctgaggcttctccattcaccccatcagaatgtctgtgagcaagcagtgtgggcattgggaaatatcataggtgatgggccccagtgtagagattatgtcataagtcttggagttgtgaaacctttactttccttcataagtccatctattcctataacattcttaagaaatgttacttgggttatggtcaacttatgtcgccacaaagacccaccaccaccaatggaaaccattcaggagattcttccagccctttgtgttttaattcatcacacagatgtaaatatactggtagacacagtctgggccctctcttaccttactgatgctggcaatgaacaaatacagatggtaatagactctggaatagttcctcatttggttcctctgctcagccaccaggaagttaaagttcagactgctgcacttagagctgtgggcaacattgttactggaactgatgagcaaacacaagtagttttgaactgtgatgctctttcacacttcccagcactcctgacacatcccaaagagaaaattaataaagaagcagtgtggttcctctccaacatcactgcaggaaatcagcagcaggtacaggcagtaattgatgccaatcttgtaccaatgataatacaccttttggataagggggattttggcactcaaaaagaagctgcttgggccataagtaacttaacaattagtggaaggaaagatcaagtggcttaccttatccaacaaaatgttatcccacctttttgcaacttgctgactgtaaaagatgcacaagttgtgcaagtagtactcgatggactaagtaatatattaaaaatggctgaagatgaggcagaaaccataggcaatcttatagaagaatgtggagggctggagaaaattgaacaacttcaaaatcatgaaaatgaagacatctacaaattggcctatgagatcattgatcagttcttctcttcagatgatattgatgaagaccctagccttgttccagaggcaattcaaggcggaacatttggtttcaattcatctgccaatgtaccaacagaagggttccagttttagaaagatgttgtggaagttaggtacaatgcagcactgagatatatatatatatatgtgtgtgtgtatatatatatatatatacatatatataaaaaggtttgatccatcaagcttggctcatgggatctgctgctgcattaaatcgggaaagaaaatgtgaagatttcatttggaatcacagaaaatgcccaaatgaggtcaagatggcgagtgggtgcgagtgagaatgagtggcaaaatgtaatgaaaactttacatgaatgcttatttaggttgttcaaagtaaaaagggctacaggtcacagatcgtcagtgcctgagaaagaacattgacttactctatatcaattgaggggaaagtgcagtaccgtcatcttcaagccttgtaagcataaaagagaataggctgcccatataagtcaaaggaaaatgagcccaggccttgctatgaagcagtgtgtgaatggacaatgttgaatgaatgtctggctcagtgatggagagccaggttcatctttgaaatctagggctcttcactcatgaagcagactcctagtcctggagtgactgtgtacgagagcgtggttgtggtgctgtatgtgaacgcatgcaagcttgattcaccttcagggggctgataacctagtaaatcatcaaaatgagatcataagtgttaatgtacactggacatgaaaacaaagactggtttagcagcagacattggtttactctgcagcctgtgttttctgtttccccctttcccacctccttccccccacccaatccttttttttttcttttttgcttttcttttctttttttttagtttttatttactttacctagtatgcctttttttagttgcttctcaagtcagaaaacttttcaggaaggtttccctgtgcatttgcaccagatgaatgtttgatgctatgaaaagctttccatatcatcaaaactaatttgtgtagatttttgcatgaaaaaaatcataaatttccctcaaaatagactgtgttgcagtacacaagttgccataatagtataaaacagtaaaatgtgcttaaaaggccatccttttcattttcagagataacataaagatctttgcatgaggtaaatctacagcatagttcatttttagattttgttgagtcctgtaaagaagaagaagaaaaaagtttcagttgtggtagaataccgtgctgtgtttaaatgttacttgttttcaaactttgttttctatgaaaatgatatggaaacttctaaaatggaatttggtgcatatgtactgctgaataaagaccgatgaagaggtttgagtagatgtacaaatcaagtaatggtttgaacacctttaataatatgcctaatctgttcaattgttttagaatctttttatcttagatgtaggcagccatgaacaatctattttgagccactttagggagaaaactttgtatttttaaaacttgcataaaagttatgcaagtggttttggaaatcctgtgccttcccctttgagcacaagtgttgcatgaacaacagtttgctataagaaac

SEQ ID NO: 850 - DNA, 1717 bp, Homo sapiens
gcacgagccatggcggacaacgagaaactggacaaccaacggctcaagaatttcaagaacaaaggccgcgacttggagactatgagaagacaacgaaatgaagttgtagttgaattaaggaagaataaaagagatgaacatctcttaaagagaaggaatgtaccacatgaagatatctgtgaagactctgatatagatggtgattatagagtgcaaaatacctctctagaagctattgttcaaaatgcttcaagtgataaccaaggaattcaattaagtgcagttcaagctgctaggaagcttttgtccagtgatcgaaatccaccaattgatgacttaataaaatctggaatattgcccattttagtccattgtcttgaaagagatgacaatccttctttacagtttgaagctgcatgggctttgacaaacattgcatctggaacttctgaacaaactcaagcagtagttcagtccaatgctgtgccacttttcctgaggcttctccattcaccccatcagaatgtctgtgagcaagcagtgtgggcattgggaaatatcataggtgatgggccccagtgtagagattatgtcataagtcttggagttgtgaaacctttactttccttcataagtccatctattcctataacattcttaagaaatgttacttgggttatggtcaacttatgtcgccacaaagacccaccaccaccaatggaaaccattcaggagattcttccagccctttgtgttttaattcatcacacagatgtaaatatactggtagacacagtctgggccctctcttaccttactgatgctggcaatgaacaaatacagatggtaatagactctggaatagttcctcatttggttcctctgctcagccaccaggaagttaaagttcagactgctgcacttagagctgtgggcaacattgttactggaactgatgagcaaacacaagtagttttgaactgtgatgctctttcacacttcccagcactcctgacacatcccaaagagaaaattaataaagaagcagtgtggttcctctccaacatcactgcaggaaatcagcagcaggtacaggcagtaattgatgccaatcttgtaccaatgataatacaccttttggataagggggattttggcactcaaaaagaagctgcttgggccataagtaacttaacaattagtggaaggaaagatcaagtggcttaccttatccaacaaaatgttatcccacctttttgcaacttgctgactgtaaaagatgcacaagttgtgcaagtagtactcgatggactaagtaatatattaaaaatggctgaagatgaggcagaaaccataggcaatcttatagaagaatgtggagggctggagaaaattgaacaacttcaaaatcatgaaaatgaagacatctacaaattggcctatgagatcattgatcagttcttctcttcagatgatattgatgaagaccctagccttgttccagaggcaattcaaggcggaacatttggtttcaattcatctgccaatgtaccaacagaagggttccagttttagaaagatgttgtggaagttaggtacaatgcagcactgagatatatatatatatatgtgtgtgtgtatatatatatatatatacatatatataaaaaggtttgatccatcaaaaaaaaaaaaaaaaaaaaaaaaaaaaaaaaaa

SEQ ID NO: 851 - DNA, 2339 bp, Homo sapiens
ggtccaccatggccctgctgcactccggccgcgtcctccccgggatcgccgccgccttccacccgggcctcgccgccgcggcctctgccagagccagctcctggtggacccatgtggaaatgggacctccagatcccattctgggagtcactgaagcctttaagagggacaccaatagcaaaaagatgaatctgggagttggtgcctaccgggatgataatggaaagccttacgttctgcctagcgtccgcaaggcagaggcccagattgccgcaaaaaatttggacaaggaatacctgcccattgggggactggctgaattttgcaaggcatctgcagaactagccctgggtgagaacagcgaagtcttgaagagtggccggtttgtcactgtgcagaccatttctggaactggagccttaaggatcggagccagttttctgcaaagattttttaagttcagccgagatgtctttctgcccaaaccaacctggggaaaccacacacccatcttcagggatgctggcatgcagctacaaggttatcggtattatgaccccaagacttgcggttttgacttcacaggcgctgtggaggatatttcaaaaataccagagcagagtgttcttcttctgcatgcctgcgcccacaatcccacgggagtggacccgcgtccggaacagtggaaggaaatagcaacagtggtgaagaaaaggaatctctttgcgttctttgacatggcctaccaaggctttgccagtggtgatggtgataaggatgcctgggctgtgcgccacttcatcgaacagggcattaatgtttgcctctgccaatcatatgccaagaacatgggcttatatggtgagcgtgtaggagccttcactatggtctgcaaagatgcggatgaagccaaaagggtagagtcacagttgaagatcttgatccgtcccatgtattccaaccctcccctcaatggggcccggattgctgctgccattctgaacaccccagatttgcgaaaacaatggctgcaagaagtgaaaggcatggctgaccgcatcattggcatgcggactcaactggtctccaacctcaagaaggagggttccacccacaattggcaacacatcaccgaccaaattggcatgttctgtttcacagggctaaagcctgaacaggtggagcggctgatcaaggagttctccatctacatgacaaaagatggccgcatctctgtggcaggggtcacctccagcaacgtgggctaccttgcccatgccattcaccaggtcaccaagtaatgtccctgggtcgaggaaacagagacaacctttctgtcttcagcctctgctattgagagcttcacacagacaatgagagagggtggatggtggtgagtggatcatttctttcagccacagtgtgtaacactcagcatttgaatgtttctcagaaaagaacatgtagtgacacagggcagaggcatccatggctggcgtctggaatattaaaccaaactctccccggtccttttttctccaacttttctcaaagagtttacatgtgcaagaaagtcatcgcaccaaaaaacctgtcaattatgccattgcaatatttcagaagctttaactgaagtgtcaggttcctcgtgagaaacaagcacaccttagaggctttgagagaaggccagctagttctgtcatgagtagtcggcctcgtgtctgtcctcccatcttggaacaaccttatcaacaggccgcactgcagaaatgatgttttatgaaaaccatgagctgctgccactccagcaagggaaataatgcagtttcctgtcttatttaagaaaaagagaaggctctcttttctcccttgtcattgccgttcttttccttacacgcaaaacatttttaactattgcagtttcatcccattctactgcttgattgaccatcaactccatcctatcgagattatttaagaatgaagaacataatttttctgctgatgccgtaccctcacccttttcagcaaagaatagtggagagtaggaaactgtactttatctcggcatcctcttgaatgatagtgcaagtttctccagttgggatgttgtctctgcccggttggacctcctccctttgttgaatgtggtgtgcagcctctcatctcacactgtgagtccagcggcgcagggtggtaccaggaaagaggatattctaggcttgcgtgctgctagctgggttcaggcttcacccactggaaagaaccaccatctgctctaaccatgtagacttattgcggcctggttttctctgttacaataaaattactgtagaccc

SEQ ID NO: 852 - DNA, 2417 bp, Homo sapiens
ggcccagcacgcggccgctctggcccagggaagtccctgtccttaccttcagcaggagccggttccctgtgtgtgtgtccgctcgccctctgctccgtcctgcggctgcccactgccctcctacggtccaccatggccctgctgcactccggccgcgtcctccccgggatcgccgccgccttccacccgggcctcgccgccgcggcctctgccagagccagctcctggtggacccatgtggaaatgggacctccagatcccattctgggagtcactgaagcctttaagagggacaccaatagcaaaaagatgaatctgggagttggtgcctaccgggatgataacggaaagccttacgtgctgcctagcgtccgcaaggcagaggcccagattgccgcaaaaaatttggacaaggaatacctgcccattgggggactggctgaattttgcaaggcatctgcagaactagccctgggtgagaacagcgaagtcttgaagagtggccggtttgtcactgtgcagaccatttctggaactggagccttaaggatcggagccagttttctgcaaagattttttaagttcagccgagatgtctttctgcccaaaccaacctggggaaaccacacacccatcttcagggatgctggcatgcagctacaaggttatcggtattatgaccccaagacttgcggttttgacttcacaggcgctgtggaggatatttcaaaaataccagagcagagtgttcttcttctgcatgcctgcgcccacaatcccacgggagtggacccgcgtccggaacagtggaaggaaatagcaacagtggtgaagaaaaggaatctctttgcgttctttgacatggcctaccaaggctttgccagtggtgatggtgataaggatgcctgggctgtgcgccacttcatcgaacagggcattaatgtttgtctctgccaatcatatgccaagaacatgggcttatatggtgagcgtgtaggagccttcactatggtctgcaaagatgcggatgaagccaaaagggtagagtcacagttgaagatcttgatccgtcccatgtattccaaccctcccctcaatggggcccggattgctgctgccattctgaacaccccagatttgcgaaaacaatggctgcaagaagtgaaaggcatggctgaccgcatcattggcatgcggactcaactggtctccaacctcaagaaggagggttccacccacaattggcaacacatcaccgaccaaattggcatgttctgtttcacagggctaaagcctgaacaggtggagcggctgatcaaggagttctccatctacatgacaaaagatggccgcatctctgtggcaggggtcacctccagcaacgtgggctaccttgcccatgccattcaccaggtcaccaagtaatgtccctggtgcgaggaaacagagacaacctttctgtcttcagcctctgctattgagagcttcacacagacaatgagagagggtggatggtggtgagtggatcatttctttcagccacagtgtgtaacactcagcatttgaatgtttctcagaaaagaacatgtagtgacacagggcagaggcatccatggctggcgtctggaatattaaaccaaactctccccggtccttttttctccaacttttctcaaagagtttacatgtgcaagaaagtcatcgcaccaaaaaacctgtcaattatgccattgcaatatttcagaagctttaactgaagtgtcaggttcctcgtgagaaacagcacacgttagaggctttgagagaaggcctagttctgtcatgagtagtcggcctcgtgtctgtcctcccatcttggaacaaccttatcaacaggccgcactgcagaaatgatgttttatgaaaaccaatgaggctgctgccactccagcaagggaaataatgcagtttcctgtcttatttaagaaaaagagaaggctctcttttctcccttgtcattgccgttcttttccttacacgcaaagattttttaactattgcagattttcatcccattctactgcttgattgaccatcaactccatcctatcgagatttatttaagaatgaagaacataattttctgctgatgccgtaccctcacccttttcagcaaagaatagtggagagtaggaaactgtactttatctcggcatcctcttgaatgatagtgcaagtttctccagttgggatgttgtctctgcccggttggacctcctccctttgttgaatgtggtgtgcagcctctcatctcacactgtgagtccagcggcgcagggtggtaccaggaaagaggatattcaaccaccatctgctctaaccatgtagacttattgcggcctggtttctctgttacaataaaattactgtagacccaa

SEQ ID NO: 853 - DNA, 2465 bp, Homo sapiens
ggcccagcacgcggccgctctggcccagggaagtccctgtccttaccttcagcaggagccggttccctgtgtgtgtgtccgctcgccctctgctccgtcctgcggctgcccactgccctcctacggtccaccatggccctgctgcactccggccgcgtcctccccgggatcgccgccgccttccacccgggcctcgccgccgcggcctctgccagagccagctcctggtggacccatgtggaaatgggacctccagatcccattctgggagtcactgaagcctttaagagggacaccaatagcaaaaagatgaatctgggagttggtgcctaccgggatgataacggaaagccttacgtgctgcctagcgtccgcaaggcagaggcccagattgccgcaaaaaatttggacaaggaatacctgcccattgggggactggctgaattttgcaaggcatctgcagaactagccctgggtgagaacagcgaagtcttgaagagtggccggtttgtcactgtgcagaccatttctggaactggagccttaaggatcggagccagttttctgcaaagattttttaagttcagccgagatgtctttctgcccaaaccaacctggggaaaccacacacccatcttcagggatgctggcatgcagctacaaggttatcggtattatgaccccaagacttgcggttttgacttcacaggcgctgtggaggatatttcaaaaataccagagcagagtgttcttcttctgcatgcctgcgcccacaatcccacgggagtggacccgcgtccggaacagtggaaggaaatagcaacagtggtgaagaaaaggaatctctttgcgttctttgacatggcctaccaaggctttgccagtggtgatggtgataaggatgcctgggctgtgcgccacttcatcgaacagggcattaatgtttgtctctgccaatcatatgccaagaacatgggcttatatggtgagcgtgtaggagccttcactatggtctgcaaagatgcggatgaagccaaaagggtagagtcacagttgaagatcttgatccgtcccatgtattccaaccctcccctcaatggggcccggattgctgctgccattctgaacaccccagatttgcgaaaacaatggctgcaagaagtgaaaggcatggctgaccgcatcattggcatgcggactcaactggtctccaacctcaagaaggagggttccacccacaattggcaacacatcaccgaccaaattggcatgttctgtttcacagggctaaagcctgaacaggtggagcggctgatcaaggagttctccatctacatgacaaaagatggccgcatctctgtggcaggggtcacctccagcaacgtgggctaccttgcccatgccattcaccaggtcaccaagtaatgtccctggtgcgaggaaacagagacaacctttctgtcttcagcctctgctattgagagcttcacacagacaatgagagagggtggatggtggtgagtggatcatttctttcagccacagtgtgtaacactcagcatttgaatgtttctcagaaaagaacatgtagtgacacagggcagaggcatccatggctggcgtctggaatattaaaccaaactctccccggtccttttttctccaacttttctcaaagagtttacatgtgcaagaaagtcatcgcaccaaaaaacctgtcaattatgccattgcaatatttcagaagctttaactgaagtgtcaggttcctcgtgagaaacagcacacgttagaggctttgagagaaggcctagttctgtcatgagtagtcggcctcgtgtctgtcctcccatcttggaacaaccttatcaacaggccgcactgcagaaatgatgttttatgaaaaccaatgaggctgctgccactccagcaagggaaataatgcagtttcctgtcttatttaagaaaaagagaaggctctcttttctcccttgtcattgccgttcttttccttacacgcaaagattttttaactattgcagattttcatcccattctactgcttgattgaccatcaactccatcctatcgagatttatttaagaatgaagaacataattttctgctgatgccgtaccctcacccttttcagcaaagaatagtggagagtaggaaactgtactttatctcggcatcctcttgaatgatagtgcaagtttctccagttgggatgttgtctctgcccggttggacctcctccctttgttgaatgtggtgtgcagcctctcatctcacactgtgagtccagcggcgcagggtggtaccaggaaagaggatattctaggctttgcgtgctgctagctgggttcaggcttcacccactggaaagaaccaccatctgctctaaccatgtagacttattgcggcctggtttctctgttacaataaaattactgtagacccaa

SEQ ID NO: 854 - DNA, 4289 bp, Homo sapiens
gaaggagcagttggttcaatctctggtaatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattcttccaaggaaccagtgcgaaggaataaaaaaatacgttgttggcctcattatcaagacgtcatctgacccaacttgtgtagagaaagaaaaggtgtatatcggaaaattaaatatgatccttgttcagatactgaaacaagaatggcccaaacattggccaacttttatcagtgatattgttggagcaagtaggaccagcgaaagtctctgtcaaaataatatggtgattcttaaactcttgagtgaagaagtatttgatttctctagtggacagataacccaagtcaaatctaagcatttaaaagacagcatgtgcaatgaattctcacagatatttcaactgtgtcagtttgtaatggaaaattctcaaaatgctccacttgtacatgcaaccttggaaacattgctcagatttctgaactggattcccctgggatatatttttgagaccaaattaatcagcacattgatttataagttcctgaatgttccaatgtttcgaaatgtctctctgaagtgcctcactgagattgctggtgtgagtgtaagccaatatgaagaacaatttgtaacactatttactctgacaatgatgcaactaaagcagatgcttcctttaaataccaatattcgacttgcgtactcaaatggaaaagatgatgaacagaacttcattcaaaatctcagtttgtttctctgcacctttcttaaggaacatgatcaacttatagaaaaaagattaaatctcagggaaactcttatggaggcccttcattatatgttgttggtatctgaagtagaagaaactgaaatctttaaaatttgtcttgaatactggaatcatttggctgctgaactctatagagagagtccattctctacatctgcctctccgttgctttctggaagtcaacattttgatgttcctcccaggagacagctatatttgcccatgttattcaaggtccgtttattaatggttagtcgaatggctaaaccagaggaagtattggttgtagagaatgatcaaggagaagttgtgagagaattcatgaaggatacagattccataaatttgtataagaatatgagggaaacattggtttatcttactcatctggattatgtagatacagaaagaataatgacagagaagcttcacaatcaagtgaatggtacagagtggtcatggaaaaatttgaatacattgtgttgggcaataggctccattagtggagcaatgcatgaagaggacgaaaaacgatttcttgttactgttataaaggatctattaggattatgtgaacagaaaagaggcaaagataataaagctattattgcatcaaatatcatgtacatagtaggtcaatacccacgttttttgagagctcactggaaatttctgaagactgtagttaacaagctgttcgaattcatgcatgagacccatgatggagtccaggatatggcttgtgatactttcattaaaatagcccaaaaatgccgcaggcatttcgttcaggttcaggttggagaagtgatgccatttattgatgaaattttgaacaacattaacactattatttgtgatcttcagcctcaacaggttcatacgttttatgaagctgtggggtacatgattggtgcacaaacagatcaaacagtacaagaacacttgatagaaaagtacatgttactccctaatcaagtgtgggatagtataatccagcaggcaaccaaaaatgtggatatactgaaagatcctgaaacagtcaagcagcttggtagcattttgaaaacaaatgtgagagcctgcaaagctgttggacacccctttgtaattcagcttggaagaatttatttagatatgcttaatgtatacaagtgcctcagtgaaaatatttctgcagctatccaagctaatggtgaaatggttacaaagcaaccattgattagaagtatgcgaactgtaaaaagggaaactttaaagttaatatctggttgggtgagccgatccaatgatccacagatggtcgctgaaaattttgttccccctctgttggatgcagttctcattgattatcagagaaatgtcccagctgctagagaaccagaagtgcttagtactatggccataattgtcaacaagttagggggacatataacagctgaaatacctcaaatatttgatgctgtttttgaatgcacattgaatatgataaataaggactttgaagaatatcctgaacatagaacgaactttttcttactacttcaggctgtcaattctcattgtttcccagcattccttgctattccacctacacagtttaaacttgttttggattccatcatttgggctttcaaacatactatgaggaatgtcgcagatacgggcttacagatactttttacactcttacaaaatgttgcacaagaagaagctgcagctcagagtttttatcaaacttatttttgtgatattctccagcatatcttttctgttgtgacagacacttcacatactgctggtttaacaatgcatgcatcaattcttgcatatatgtttaatttggttgaagaaggaaaaataagtacatcattaaatcctggaaatccagttaacaaccaaatctttcttcaggaatatgtggctaatctccttaagtcggccttccctcacctacaagatgctcaagtaaagctctttgtgacagggcttttcagcttaaatcaagatattcctgctttcaaggaacatttaagagatttcctagttcaaataaaggaatttgcaggtgaagacacttctgatttgtttttggaagagagagaaatagccctacggcaggctgatgaagagaaacataaacgtcaaatgtctgtccctggcatctttaatccacatgagattccagaagaaatgtgtgattaaaatccaaattcatgctgttttttttctctgcaactcgttagcagaggaaaacagcatgtgggtatttgtcgaccaaaatgatgccaatttgtaaattaaaatgtcacctagtggccctttttcttatgtgtttttttgtataagaaattttctgtgaaatatccttccattgtttaagcttttgttttggtcatctttatttagtttgcatgaagttgaaaattaaggcatttttaaaaattttacttcatgcccatttttgtggctgggctggggggaggaggcaaattcgatttgaacatatacttgtaattctaatgcaaaattatacaatttttcctgtaaacaataccaatttttaattagggagcattttccttctagtctatttcagcctagaagaaaagataatgagtaaaacaaattgcgttgtttaaaggattatagtgctgcattgtctgaagttagcacctcttggactgaatcgtttgtctagactacatgtattacaaagtctctttggcaagattgcagcaagatcatgtgcatatcatcccattgtaaagcgacttcaaaaatatgggaacacagttagttatttttacacagttctttttgtttttgtgtgtgtgtgctgtcgcttgtcgacaacagctttttgttttcctcaatgaggagtgttgctcatttgtgagccttcattaactcgaagtgaaatggttaaaaatatttatcctgttagaataggctgcatctttttaacaactcattaaaaaacaaaacaactctggcttttgagatgacttatactaatttacattgtttaccaagctgtagtgctttaagaacactacttaaaaagcaaaataaacttggtttacatttatttttcctttattgactcatttattcctatattaatgatagtgggtatttgtgtttaagcatcaagtaacattttaaatgaagttggaccccttgatttacaaacaagatttctaaggttattgttcctagtaaatgcagcagttgtgtaaaatg

SEQ ID NO: 855 - DNA, 4392 bp, Homo sapiens
ggctgcagcggccgcggcaggagcagcgggagctacagcatcagcaagagcaacagtagctacagccccggcggcggtgcctgttccagtctttgctgctgcagaaggagcagttggttcaatctctggtaatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattcttccaaggaaccagtgcgaaggaataaaaaaatacgttgttggcctcattatcaagacgtcatctgacccaacttgtgtagagaaagaaaaggtgtatatcggaaaattaaatatgatccttgttcagatactgaaacaagaatggcccaaacattggccaacttttatcagtgatattgttggagcaagtaggaccagcgaaagtctctgtcaaaataatatggtgattcttaaactcttgagtgaagaagtatttgatttctctagtggacagataacccaagtcaaatctaagcatttaaaagacagcatgtgcaatgaattctcacagatatttcaactgtgtcagtttgtaatggaaaattctcaaaatgctccacttgtacatgcaaccttggaaacattgctcagatttctgaactggattcccctgggatatatttttgagaccaaattaatcagcacattgatttataagttcctgaatgttccaatgtttcgaaatgtctctctgaagtgcctcactgagattgctggtgtgagtgtaagccaatatgaagaacaatttgtaacactatttactctgacaatgatgcaactaaagcagatgcttcctttaaataccaatattcgacttgcgtactcaaatggaaaagatgatgaacagaacttcattcaaaatctcagtttgtttctctgcacctttcttaaggaacatgatcaacttatagaaaaaagattaaatctcagggaaactcttatggaggcccttcattatatgttgttggtatctgaagtagaagaaactgaaatctttaaaatttgtcttgaatactggaatcatttggctgctgaactctatagagagagtccattctctacatctgcctctccgttgctttctggaagtcaacattttgatgttcctcccaggagacagctatatttgcccatgttattcaaggtccgtttattaatggttagtcgaatggctaaaccagaggaagtattggttgtagagaatgatcaaggagaagttgtgagagaattcatgaaggatacagattccataaatttgtataagaatatgagggaaacattggtttatcttactcatctggattatgtagatacagaaagaataatgacagagaagcttcacaatcaagtgaatggtacagagtggtcatggaaaaatttgaatacattgtgttgggcaataggctccattagtggagcaatgcatgaagaggacgaaaaacgatttcttgttactgttataaaggatctattaggattatgtgaacagaaaagaggcaaagataataaagctattattgcatcaaatatcatgtacatagtaggtcaatacccacgttttttgagagctcactggaaatttctgaagactgtagttaacaagctgttcgaattcatgcatgagacccatgatggagtccaggatatggcttgtgatactttcattaaaatagcccaaaaatgccgcaggcatttcgttcaggttcaggttggagaagtgatgccatttattgatgaaattttgaacaacattaacactattatttgtgatcttcagcctcaacaggttcatacgttttatgaagctgtggggtacatgattggtgcacaaacagatcaaacagtacaagaacacttgatagaaaagtacatgttactccctaatcaagtgtgggatagtataatccagcaggcaaccaaaaatgtggatatactgaaagatcctgaaacagtcaagcagcttggtagcattttgaaaacaaatgtgagagcctgcaaagctgttggacacccctttgtaattcagcttggaagaatttatttagatatgcttaatgtatacaagtgcctcagtgaaaatatttctgcagctatccaagctaatggtgaaatggttacaaagcaaccattgattagaagtatgcgaactgtaaaaagggaaactttaaagttaatatctggttgggtgagccgatccaatgatccacagatggtcgctgaaaattttgttccccctctgttggatgcagttctcattgattatcagagaaatgtcccagctgctagagaaccagaagtgcttagtactatggccataattgtcaacaagttagggggacatataacagctgaaatacctcaaatatttgatgctgtttttgaatgcacattgaatatgataaataaggactttgaagaatatcctgaacatagaacgaactttttcttactacttcaggctgtcaattctcattgtttcccagcattccttgctattccacctacacagtttaaacttgttttggattccatcatttgggctttcaaacatactatgaggaatgtcgcagatacgggcttacagatactttttacactcttacaaaatgttgcacaagaagaagctgcagctcagagtttttatcaaacttatttttgtgatattctccagcatatcttttctgttgtgacagacacttcacatactgctggtttaacaatgcatgcatcaattcttgcatatatgtttaatttggttgaagaaggaaaaataagtacatcattaaatcctggaaatccagttaacaaccaaatctttcttcaggaatatgtggctaatctccttaagtcggccttccctcacctacaagatgctcaagtaaagctctttgtgacagggcttttcagcttaaatcaagatattcctgctttcaaggaacatttaagagatttcctagttcaaataaaggaatttgcaggtgaagacacttctgatttgtttttggaagagagagaaatagccctacggcaggctgatgaagagaaacataaacgtcaaatgtctgtccctggcatctttaatccacatgagattccagaagaaatgtgtgattaaaatccaaattcatgctgttttttttctctgcaactcgttagcagaggaaaacagcatgtgggtatttgtcgaccaaaatgatgccaatttgtaaattaaaatgtcacctagtggccctttttcttatgtgtttttttgtataagaaattttctgtgaaatatccttccattgtttaagcttttgttttggtcatctttatttagtttgcatgaagttgaaaattaaggcatttttaaaaattttacttcatgcccatttttgtggctgggctggggggaggaggcaaattcgatttgaacatatacttgtaattctaatgcaaaattatacaatttttcctgtaaacaataccaatttttaattagggagcattttccttctagtctatttcagcctagaagaaaagataatgagtaaaacaaattgcgttgtttaaaggattatagtgctgcattgtctgaagttagcacctcttggactgaatcgtttgtctagactacatgtattacaaagtctctttggcaagattgcagcaagatcatgtgcatatcatcccattgtaaagcgacttcaaaaatatgggaacacagttagttatttttacacagttctttttgtttttgtgtgtgtgtgctgtcgcttgtcgacaacagctttttgttttcctcaatgaggagtgttgctcatttgtgagccttcattaactcgaagtgaaatggttaaaaatatttatcctgttagaataggctgcatctttttaacaactcattaaaaaacaaaacaactctggcttttgagatgacttatactaatttacattgtttaccaagctgtagtgctttaagaacactacttaaaaagcaaaataaacttggtttacatttatttttcctttattgactcatttattcctatattaatgatagtgggtatttgtgtttaagcatcaagtaacattttaaatgaagttggaccccttgatttacaaacaagatttctaaggttattgttcctagtaaatgcagcagttgtgtaaaatg

SEQ ID NO: 856 - DNA, 4399 bp, Homo sapiens
ggggagaagcggctgcagcggccgcggcaggagcagcgggagctacagcatcagcaagagcaacagtagctacagccccggcggcggtgcctgttccagtctttgctgctgcagtccgtgcaaccacccagagggggaggggggaaccaccagtcgctgaggaacaagagaaggggggaaagtttaggcgagccttgggggggggggggccagcgccggagccgcgtgagagagggagccgtgttttggtaggggggagtcggactgcaactggcagcagagcgtctccccggccgtgtggactctacaccccctactcctgccgcttctgctgctgcctgtggctggagggtccccctggggctgaatctttgggacttgaccccgttccctcccccttccctcactccccagccgggcgggagcatttattccccagattaattccccttttgggggggggcgggtgtgtgtgtgtgtgtgtgtgtgtgtgtgtgttgggggaagcgtccctgaaatagtaaatattattgagctctttttgcccttttcctgtccgtttttttaatttccttttttgaggtgggaaaactgaaacccaccttgattcgtcccctctcccccctccccaccttccctcgccctaatcccccaacgaggaaggaaggagcagttggttcaatctctggtaatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattcttccaaggaaccagtgcgaaggaataaaaaaatacgttgttggcctcattatcaagacgtcatctgacccaacttgtgtagagaaagaaaaggtgtatatcggaaaattaaatatgatccttgttcagatactgaaacaagaatggcccaaacattggccaacttttatcagtgatattgttggagcaagtaggaccagcgaaagtctctgtcaaaataatatggtgattcttaaactcttgagtgaagaagtatttgatttctctagtggacagataacccaagtcaaatctaagcatttaaaagacagcatgtgcaatgaattctcacagatatttcaactgtgtcagtttgtaatggaaaattctcaaaatgctccacttgtacatgcaaccttggaaacattgctcagatttctgaactggattcccctgggatatatttttgagaccaaattaatcagcacattgatttataagttcctgaatgttccaatgtttcgaaatgtctctctgaagtgcctcactgagattgctggtgtgagtgtaagccaatatgaagaacaatttgtaacactatttactctgacaatgatgcaactaaagcagatgcttcctttaaataccaatattcgacttgcgtactcaaatggaaaagatgatgaacagaacttcattcaaaatctcagtttgtttctctgcacctttcttaaggaacatgatcaacttatagaaaaaagattaaatctcagggaaactcttatggaggcccttcattatatgttgttggtatctgaagtagaagaaactgaaatctttaaaatttgtcttgaatactggaatcatttggctgctgaactctatagagagagtccattctctacatctgcctctccgttgctttctggaagtcaacattttgatgttcctcccaggagacagctatatttgcccatgttattcaaggtccgtttattaatggttagtcgaatggctaaaccagaggaagtattggttgtagagaatgatcaaggagaagttgtgagagaattcatgaaggatacagattccataaatttgtataagaatatgagggaaacattggtttatcttactcatctggattatgtagatacagaaagaataatgacagagaagcttcacaatcaagtgaatggtacagagtggtcatggaaaaatttgaatacattgtgttgggcaataggctccattagtggagcaatgcatgaagaggacgaaaaacgatttcttgttactgttataaaggatctattaggattatgtgaacagaaaagaggcaaagataataaagctattattgcatcaaatatcatgtacatagtaggtcaatacccacgttttttgagagctcactggaaatttctgaagactgtagttaacaagctgttcgaattcatgcatgagacccatgatggagtccaggatatggcttgtgatactttcattaaaatagcccaaaaatgccgcaggcatttcgttcaggttcaggttggagaagtgatgccatttattgatgaaattttgaacaacattaacactattatttgtgatcttcagcctcaacaggttcatacgttttatgaagctgtggggtacatgattggtgcacaaacagatcaaacagtacaagaacacttgatagaaaagtacatgttactccctaatcaagtgtgggatagtataatccagcaggcaaccaaaaatgtggatatactgaaagatcctgaaacagtcaagcagcttggtagcattttgaaaacaaatgtgagagcctgcaaagctgttggacacccctttgtaattcagcttggaagaatttatttagatatgcttaatgtatacaagtgcctcagtgaaaatatttctgcagctatccaagctaatggtgaaatggttacaaagcaaccattgattagaagtatgcgaactgtaaaaagggaaactttaaagttaatatctggttgggtgagccgatccaatgatccacagatggtcgctgaaaattttgttccccctctgttggatgcagttctcattgattatcagagaaatgtcccagctgctagagaaccagaagtgcttagtactatggccataattgtcaacaagttagggggacatataacagctgaaatacctcaaatatttgatgctgtttttgaatgcacattgaatatgataaataaggactttgaagaatatcctgaacatagaacgaactttttcttactacttcaggctgtcaattctcattgtttcccagcattccttgctattccacctacacagtttaaacttgttttggattccatcatttgggctttcaaacatactatgaggaatgtcgcagatacgggcttacagatactttttacactcttacaaaatgttgcacaagaagaagctgcagctcagagtttttatcaaacttatttttgtgatattctccagcatatcttttctgttgtgacagacacttcacatactgctggtttaacaatgcatgcatcaattcttgcatatatgtttaatttggttgaagaaggaaaaataagtacatcattaaatcctggaaatccagttaacaaccaaatctttcttcaggaatatgtggctaatctccttaagtcggccttccctcacctacaagatgctcaagtaaagctctttgtgacagggcttttcagcttaaatcaagatattcctgctttcaaggaacatttaagagatttcctagttcaaataaaggaatttgcaggtgaagacacttctgatttgtttttggaagagagagaaatagccctacggcaggctgatgaagagaaacataaacgtcaaatgtctgtccctggcatctttaatccacatgagattccagaagaaatgtgtgattaaaatccaaattcatgctgttttttttctctgcaactcgttagcagaggaaaacagcatgtgggtatttgtcgaccaaaatgatgccaatttgtaaattaaaatgtcacctagtggccctttttcttatgtgtttttttgtataagaaattttctgtgaaatatccttccattgtttaagcttttgttttggtcatctttatttagtttgcatgaagttgaaaattaaggcatttttaaaaattttacttcatgcccatttttgtggctgggctggggggaggaggcaaattcgatttgaacatatacttgtaattctaatgcaaaattatacaatttttcctgtaaacaataccaatttttaattagggagcattttccttctagtctatttcagcctagaagaaaagataatgacacctcttggactgaatcgtttgtctagactacatgtattacaaagtctctttggcaagattgcagcaagatca

SEQ ID NO: 857 - DNA, 3134 bp, Homo sapiens
ccggcgccctggttggcgccctgcccccaaagtccgtcctccccgttaggtggcgcccaaggggaggggacagccgggcaggcaggaagctgcggcttaaaagggcaacccgcgccggacccttccttcctagtcgcggggagtctgagaaagcgcacctgttccgcgaccgtcacgcacccctcctccgcctgccgcgatgtaccgctacctggccaaagcgctgctgccgtcccgggccgggcccgctgccctgggctccgcggccaaccactcggccgcgttgctgggccggggccgcggacagcccgccgccgcctcgcagccggggctcgcattggccgcccggcgccactacagcgagttggtggccgaccgcgaggacgaccccaacttcttcaagatggtggagggcttcttcgatcgcggcgccagcatcgtggaggacaagttggtgaaggacctgaggacccaggaaagcgaggagcagaagcggaaccgggtgcgcggcatcctgcggatcatcaagccctgcaaccatgtgctgagtctctccttccccatccggcgcgacgacggctcctgggaggtcatcgaaggctaccgggcccagcacagccagcaccgcacgccctgcaagggaggtatccgttacagcactgatgtgagtgtagatgaagtaaaagctttggcttctctgatgacatacaagtgtgcagtggttgatgtgccgtttgggggtgctaaagctggtgttaagatcaatcccaagaactataccgaaaatgaattggaaaagatcacaaggaggttcaccatggagctagcaaagaagggctttattggtcctggcgttgatgtgcctgctccagacatgaacacaggtgagcgggagatgtcctggattgctgatacctatgccagcaccatagggcactatgatattaatgcacacgcctgtgttactggtaaacccatcagccaagggggaatccatggacgcatctctgctactggccgtggtgtcttccatgggattgaaaacttcatcaatgaagcttcttacatgagcattttaggaatgacaccagggtttagagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggtcgactgtgacatactgatcccagctgccactgagaagcagttgaccaaatccaacgcacccagagtcaaagccaagatcattgctgaaggtgccaatgggccaacaactccagaagctgataagatcttcctggagagaaacattttggttattccagatctctacttgaatgctggaggagtgacagtatcttactttgagtggctgaagaatctaaatcatgtcagctatggccgtttgaccttcaaatatgaaagggattctaactaccacttgctcctgtctgttcaagagagtttagaaagaaaatttggaaagcatggtggaactattcccattgtacccacggcagagttccaagacagtatatcgggtgcatctgagaaagacattgtgcactctgccttggcatacacaatggagcgttctgccaggcaaattatgcacacagccatgaagtataacctgggattggacctgagaacagctgcctatgtcaatgccattgaaaaagtcttcaaagtgtacagtgaagctggtgtgaccttcacatagatggatcatggctgacttcctcactaacctcttcacgtgtaacttctgcagacctaccacaagtttacatgtaaccacagaaatccctttctctcctgactcattactaatggataccattctcaacaagtcaatccaaatcagcccgttaaggagaaagaaattaatatacaagctgagtgtgaaagtagaaatcacctacaccagagagctattttggtattttgcctttaaataaaaagcctcctccatatggctgtgcagccttgctctgtggcttttcccagcacaatcagtgctagtgctggggaagggacagtcaagagcagtcagttgcttacttattttgctctggatgagtctgggacacgctgtaactttaacacatttaagaagaaggtgtgtggccttttcagaaggtggcatggtcctcaagtgagttcttagtattttatatcagcaaaataactcaattttgcagattgcaaacaaatataaaagctgtttctgtttatgaattttattcttttagaatagaataagtacatgctgctgtaataaaattgcctttaatcacttaacaagcctaaccttgactcagtgaatgcctataaaaataataaatgaaaaaaaacagtatttttatatcataaaagtttcatttgtagcttatcattcacgtattgttgtccagcaaacattaaaagccctgtggataattacgttatcttcatacctgcaaaacggtggaggctattttcgttaaaactgtcagaattcgctgttataattatgacacatagtccaaagaatgcagtaacctttttatcatgttaactaattgttctcttttgaagatctatggttgactaattaaacaataattcaagtagagtgtcccagaaaaaaaccacttgggctccctgattggagtctggctggctctgagcattgccaatggcccctactcacctgactttgtatcctcttcttttagaggctttgcattctgcacccagcttcactaacagtgggctgaaaccaaccttgggttgagtgtttcatttgggagttatttggccagggccttttgaacaatagtgtccccatgaagtgctagataatatatgtgtaagaatcagcttttttttttttaactataatatccttcagaaatttctaactactttgtaactgcatggcttaacctggtgataaaagcagttattaaaagtctacatttttttttaaaaaaaga

SEQ ID NO: 858 - DNA, 2760 bp, Homo sapiens
agaaagcgcgcctgtttcgcgaccatcacgcacctcccctccgcttgtggccatgtaccgctacctggtggaggacctgaggacccgggagagcgaggagcagaagcggaaccgggtgcgcggcatcctgcggatcatcaagccctgcaaccatgtgctgagtctctccttccccatccggcgcgacgacggctcctgggaggtcatcgaaggctaccgggcccagcacagccagcaccgcacgccctgcaagggaggtatccgttacagcactgatgtgagtgtagatgaagtaaaagctttggcttctctgatgacatacaagtgtgcagtggttgatgtgccgtttgggggtgctaaagctggtgttaagatcaatcccaagaactatactgataatgaattggaaaagatcacaaggaggttcaccatggagctagcaaaaaagggctttattggtcctggcattgatgtgcctgctccagacatgagcacaggtgagcgggagatgtcctggatcgctgatacctatgccagcaccatagggcactatgatattaatgcacacgcctgtgttactggtaaacccatcagccaagggggaatccatggacgcatctctgctactggccgtggtgtcttccatgggattgaaaatttcatcaatgaagcttcttacatgagcattttaggaatgacaccagggtttggagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggccgactgtgacatactgatcccagctgccagtgagaagcagttgaccaaatccaacgcacccagagtcaaagccaagatcattgctgaaggtgccaatgggccaacaactccagaagctgacaagatcttcctggagagaaacattatggttattccagatctctacttgaatgctggaggagtgacagtatcttactttgagtggctgaagaatctaaatcatgtcagctatggccgtttgaccttcaaatatgaaagggattctaactaccacttgctcatgtctgttcaagagagtttagaaagaaaatttggaaagcatggtggaactattcccattgtacccacggcagagttccaagacaggatatcgggtgcatctgagaaagacatcgtgcactctggcttggcatacacaatggagcgttctgccaggcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaagaaattaaggttagcggatcatgtacaagctgagtgtgaaagtagaaatcacctacaccagagagccattttggtattttgcctttaaataaaaagcctcctttatctggctgtgcagccttgctctgtggcttttcccaacacaatcagtgctagtgctggggaggaacagtcaagagcagtcagttgcttgcttattttttctggatgagtctgggacacactgtaactttaacacatttaagaagtaggtgtgtggccttttcagaaggtggcatggtcctcaagtgagttcttagtattttatatcagcaaaataattcaattttgcaggttgcaaacaaatataaaacctgtttctgtttatgaatattattcttttagaatagaataagtacatgctgctgtaataaaattgcctttaatcacttaacaagcctaaccttgactcaaacagtgaatgcctatagaaataataaatgaaaaaaactagtatttttatatcataaaacaatgtcatttatagcttatcattcatgtattgtccagcagacattaaaagccctgtggataattaagttatcttcatacctgcaaaatggtggaggctattttcattaaaactgtcagaatttgcttactataattatgatacagtccaaagaatgcagtcactttttatcatgttaactaattgttctcttttgaagatctatggttgactaattaaacaataattcaagtagagtgtcccagaaaaaaaccacttgggctccctgtttggagtctggctggctctgagcattgccaatggcccctactcacctgactttgtatcctctccttttagaggctttgcattctgcacccagcttcactaacagtgggctgaaaacatccttgggttgagtgtttcatttgggagttatttggccagggccttttgaacagtagtgtccccatgaagtgctagataatatatgtgtaagagtcagctttttttttttttttaactctaacacccttcagaaatttctaactactttgtaactgcatggcttaacctggtgataaaagcagttattaaaagtctacgttttccaaaacttacg

SEQ ID NO: 859 - DNA, 2758 bp, Homo sapiens
aggcggaggcccggcgccctgggcggcgccctgtccccgaagtccgtcctccccgttaggtggcgagcgcccgaggggaggggacagccgggcaagagcagaagcggaaccgggtgcgcggcatcctgcggatcatcaagccctgcaaccatgtgctgagtctctccttccccatccggcgcgacgacggctcctgggaggtcatcgaaggctaccgggcccagcacagccagcaccgcacgccctgcaagggaggtatccgttacagcactgatgtgagtgtagatgaagtaaaagctttggcttctctgatgacatacaagtgtgcagtggttgatgtgccgtttgggggtgctaaagctggtgttaagatcaatcccaagaactatactgataatgaattggaaaagatcacaaggaggttcaccatggagctagcaaaaaagggctttattggtcctggcattgatgtgcctgctccagacatgagcacaggtgagcgggagatgtcctggatcgctgatacctatgccagcaccatagggcactatgatattaatgcacacgcctgtgttactggtaaacccatcagccaagggggaatccatggacgcatctctgctactggccgtggtgtcttccatgggattgaaaatttcatcaatgaagcttcttacatgagcattttaggaatgacaccagggtttggagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggccgactgtgacatactgatcccagctgccagtgagaagcagttgaccaaatccaacgcacccagagtcaaagccaagatcattgctgaaggtgccaatgggccaacaactccagaagctgacaagatcttcctggagagaaacattatggttattccagatctctacttgaatgctggaggagtgacagtatcttactttgagtggctgaagaatctaaatcatgtcagctatggccgtttgaccttcaaatatgaaagggattctaactaccacttgctcatgtctgttcaagagagtttagaaagaaaatttggaaagcatggtggaactattcccattgtacccacggcagagttccaagacaggatatcgggtgcatctgagaaagacatcgtgcactctggcttggcatacacaatggagcgttctgccaggcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaagaaattaaggttagcggatcatgtacaagctgagtgtgaaagtagaaatcacctacaccagagagccattttggtattttgcctttaaataaaaagcctcctttatctggctgtgcagccttgctctgtggcttttcccaacacaatcagtgctagtgctggggaggaacagtcaagagcagtcagttgcttgcttattttttctggatgagtctgggacacactgtaactttaacacatttaagaagtaggtgtgtggccttttcagaaggtggcatggtcctcaagtgagttcttagtattttatatcagcaaaataattcaattttgcaggttgcaaacaaatataaaacctgtttctgtttatgaatattattcttttagaatagaataagtacatgctgctgtaataaaattgcctttaatcacttaacaagcctaaccttgactcaaacagtgaatgcctatagaaataataaatgaaaaaaactagtatttttatatcataaaacaatgtcatttatagcttatcattcatgtattgtccagcagacattaaaagccctgtggataattaagttatcttcatacctgcaaaatggtggaggctattttcattaaaactgtcagaatttgcttactataattatgatacagtccaaagaatgcagtcactttttatcatgttaactaattgttctcttttgaagatctatggttgactaattaaacaataattcaagtagagtgtcccagaaaaaaaccacttgggctccctgtttggagtctggctggctctgagcattgccaatggcccctactcacctgactttgtatcctctccttttagaggctttgcattctgcacccagcttcactaacagtgggctgaaaacatccttgggttgagtgtttcatttgggagttatttggccagggccttttgaacagtagtgtccccatgaagtgctagataatatatgtgtaagagtcagctttttttttttttttaactctaacacccttcagaaatttctaactactttgtaactgcatggcttaacctggtgataaaagcagttattaaaagtctacgttttccaaaacttacg

SEQ ID NO: 860 - DNA, 3214 bp, Homo sapiens
gacgccccgccggcgcgcgctgccgccagcgaggcccggggaggccgcggcggaggcggaggcccggcgccctgggcggcgccctgtccccgaagtccgtcctccccgttaggtggcgagcgcccgaggggaggggacagccgggcaagcaggaagctgcggcttaaaagggcaacccgcgcgggacccttcctccctagtcgcggggagtctgagaaagcgcgcctgtttcgcgaccatcacgcacctcccctccgcttgtggccatgtaccgctacctgggcgaagcgctgttgctgtcccgggccgggcccgctgccctgggctcggcgtccgccgactcggccgcgttgctgggctgggcccggggacagcccgccgccgccccgcagccggggctggcattggccgcccggcgccactacagcgaggcggtggccgaccgcgaggacgaccccaacttcttcaagatggtggagggcttcttcgatcgcggcgccagcatcgtggaggacaagctggtggaggacctgaggacccgggagagcgaggagcagaagcggaaccgggtgcgcggcatcctgcggatcatcaagccctgcaaccatgtgctgagtctctccttccccatccggcgcgacgacggctcctgggaggtcatcgaaggctaccgggcccagcacagccagcaccgcacgccctgcaagggaggtatccgttacagcactgatgtgagtgtagatgaagtaaaagctttggcttctctgatgacatacaagtgtgcagtggttgatgtgccgtttgggggtgctaaagctggtgttaagatcaatcccaagaactatactgataatgaattggaaaagatcacaaggaggttcaccatggagctagcaaaaaagggctttattggtcctggcattgatgtgcctgctccagacatgagcacaggtgagcgggagatgtcctggatcgctgatacctatgccagcaccatagggcactatgatattaatgcacacgcctgtgttactggtaaacccatcagccaagggggaatccatggacgcatctctgctactggccgtggtgtcttccatgggattgaaaatttcatcaatgaagcttcttacatgagcattttaggaatgacaccagggtttggagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggccgactgtgacatactgatcccagctgccagtgagaagcagttgaccaaatccaacgcacccagagtcaaagccaagatcattgctgaaggtgccaatgggccaacaactccagaagctgacaagatcttcctggagagaaacattatggttattccagatctctacttgaatgctggaggagtgacagtatcttactttgagtggctgaagaatctaaatcatgtcagctatggccgtttgaccttcaaatatgaaagggattctaactaccacttgctcatgtctgttcaagagagtttagaaagaaaatttggaaagcatggtggaactattcccattgtacccacggcagagttccaagacaggatatcgggtgcatctgagaaagacatcgtgcactctggcttggcatacacaatggagcgttctgccaggcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaagaaattaaggttagcggatcatgtacaagctgagtgtgaaagtagaaatcacctacaccagagagccattttggtattttgcctttaaataaaaagcctcctttatctggctgtgcagccttgctctgtggcttttcccaacacaatcagtgctagtgctggggaggaacagtcaagagcagtcagttgcttgcttattttttctggatgagtctgggacacactgtaactttaacacatttaagaagtaggtgtgtggccttttcagaaggtggcatggtcctcaagtgagttcttagtattttatatcagcaaaataattcaattttgcaggttgcaaacaaatataaaacctgtttctgtttatgaatattattcttttagaatagaataagtacatgctgctgtaataaaattgcctttaatcacttaacaagcctaaccttgactcaaacagtgaatgcctatagaaataataaatgaaaaaaactagtatttttatatcataaaacaatgtcatttatagcttatcattcatgtattgtccagcagacattaaaagccctgtggataattaagttatcttcatacctgcaaaatggtggaggctattttcattaaaactgtcagaatttgcttactataattatgatacagtccaaagaatgcagtcactttttatcatgttaactaattgttctcttttgaagatctatggttgactaattaaacaataattcaagtagagtgtcccagaaaaaaaccacttgggctccctgtttggagtctggctggctctgagcattgccaatggcccctactcacctgactttgtatcctctccttttagaggctttgcattctgcacccagcttcactaacagtgggctgaaaacatccttgggttgagtgtttcatttgggagttatttggccagggccttttgaacagtagtgtccccatgaagtgctagataatatatgtgtaagagtcagctttttttttttttttaactctaacacccttcagaaatttctaactactttgtaactgcatggcttaacctggtgataaaagcagttattaaaagtctacgttttccaaaacttacg

SEQ ID NO: 861 - DNA, 2341 bp, Homo sapiens
gaaagcgcgcctgtttcgcgaccatcacgcacctcccctccgcttgtggccatgtaccgctacctgggcgaagcgctgttgctgtcccgggccgggcccgctgccctgggctcggcgtccgccgactcggccgcgttgctgggctgggcccggggacagcccgccgccgccccgcagccggggctggcattggccgcccggcgccactacagcgaggcggtggccgaccgcgaggacgaccccaacttcttcaagatggtggagggcttcttcgatcgcggcgccagcatcgtggaggacaagctggtggaggacctgaggacccgggagagcgaggagcagaagcggaaccgggtgcgcggcatcctgcggatcatcaagccctgcaaccatgtgctgagtctctccttccccatccggcgcgacgacggctcctgggaggtcatcgaaggctaccgggcccagcacagccagcaccgcacgccctgcaagggaggtatccgttacagcactgatgtgagtgtagatgaagtaaaagctttggcttctctgatgacatacaagtgtgcagtggttgatgtgccgtttgggggtgctaaagctggtgttaagatcaatcccaagaactatactgataatgaattggaaaagatcacaaggaggttcaccatggagctagcaaaaaagggctttattggtcctggcattgatgtgcctgctccagacatgagcacaggtgagcgggagatgtcctggatcgctgatacctatgccagcaccatagggcactatgatattaatgcacacgcctgtgttactggtaaacccatcagccaagggggaatccatggacgcatctctgctactggccgtggtgtcttccatgggattgaaaatttcatcaatgaagcttcttacatgagcattttaggaatgacaccagggtttggagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggccgactgtgacatactgatcccagctgccagtgagaagcagttgaccaaatccaacgcacccagagtcaaagccaagatcattgctgaaggtgccaatgggccaacaactccagaagctgacaagatcttcctggagagaaacattatggttattccagatctctacttgaatgctggaggagtgacagtatcttactttgagtggctgaagaatctaaatcatgtcagctatggccgtttgaccttcaaatatgaaagggattctaactaccacttgctcatgtctgttcaagagagtttagaaagaaaatttggaaagcatggtggaactattcccattgtacccacggcagagttccaagacaggatatcgggtgcatctgagaaagacatcgtgcactctggcttggcatacacaatggagcgttctgccaggcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaagaaattaaggttagcggatcatgtacaagctgagtgtgaaagtagaaatcacctacaccagagagccattttggtattttgcctttaaataaaaagcctcctttatctggctgtgcagccttgctctgtggcttttcccaacacaatcagtgctagtgctggggaggaacagtcaagagcagtcagttgcttgcttattttttctggatgagtctgggacacactgtaactttaacacatttaagaagtaggtgtgtggccttttcagaaggtggcatggtcctcaagtgagttcttagtattttatatcagcaaaataattcaattttgcaggttgcaaacaaatataaaacctgtttctgtttatgaatattattcttttagaatagaataagtacatgctgctgtaataaaattgcctttaatcacttaaaaaaaaaaaaaaaaaaaaaaa

SEQ ID NO: 862 - DNA, 2738 bp, Homo sapiens
acccggaggtccggcgccctggttggcgccctgcccccaaagtccgtcctccccgttaggtggcgcccaaggggaggggacagccgggcagcagaagcggaaccgggtgcgcggcatcctgcggatcatcaagccctgcaaccatgtgctgagtctctccttccccatccggcgcgacgacggctcctgggaggtcatcgaaggctaccgggcccagcacagccagcaccgcacgccctgcaagggaggtatccgttacagcactgatgtgagtgtagatgaagtaaaagctttggcttctctgatgacatacaagtgtgcagtggttgatgtgccgtttgggggtgctaaagctggtgttaagatcaatcccaagaactataccgaaaatgaattggaaaagatcacaaggaggttcaccatggagctagcaaagaagggctttattggtcctggcgttgatgtgcctgctccagacatgaacacaggtgagcgggagatgtcctggattgctgatacctatgccagcaccatagggcactatgatattaatgcacacgcctgtgttactggtaaacccatcagccaagggggaatccatggacgcatctctgctactggccgtggtgtcttccatgggattgaaaacttcatcaatgaagcttcttacatgagcattttaggaatgacaccagggtttagagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggtcgactgtgacatactgatcccagctgccactgagaagcagttgaccaaatccaacgcacccagagtcaaagccaagatcattgctgaaggtgccaatgggccaacaactccagaagctgataagatcttcctggagagaaacattttggttattccagatctctacttgaatgctggaggagtgacagtatcttactttgagtggctgaagaatctaaatcatgtcagctatggccgtttgaccttcaaatatgaaagggattctaactaccacttgctcctgtctgttcaagagagtttagaaagaaaatttggaaagcatggtggaactattcccattgtacccacggcagagttccaagacagtatatcgggtgcatctgagaaagacattgtgcactctgccttggcatacacaatggagcgttctgccaggcaaattatgcacacagccatgaagtataacctgggattggacctgagaacagctgcctatgtcaatgccattgaaaaagtcttcaaagtgtacagtgaagctggtgtgaccttcacatagatggatcatggctgacttcctcactaacctcttcacgtgtaacttctgcagacctaccacaagtttacatgtaaccacagaaatccctttctctcctgactcattactaatggataccattctcaacaagtcaatccaaatcagcccgttaaggagaaagaaattaatatacaagctgagtgtgaaagtagaaatcacctacaccagagagctattttggtattttgcctttaaataaaaagcctcctccatatggctgtgcagccttgctctgtggcttttcccagcacaatcagtgctagtgctggggaagggacagtcaagagcagtcagttgcttacttattttgctctggatgagtctgggacacgctgtaactttaacacatttaagaagaaggtgtgtggccttttcagaaggtggcatggtcctcaagtgagttcttagtattttatatcagcaaaataactcaattttgcagattgcaaacaaatataaaagctgtttctgtttatgaattttattcttttagaatagaataagtacatgctgctgtaataaaattgcctttaatcacttaacaagcctaaccttgactcagtgaatgcctataaaaataataaatgaaaaaaaacagtatttttatatcataaaagtttcatttgtagcttatcattcacgtattgttgtccagcaaacattaaaagccctgtggataattacgttatcttcatacctgcaaaacggtggaggctattttcgttaaaactgtcagaattcgctgttataattatgacacatagtccaaagaatgcagtaacctttttatcatgttaactaattgttctcttttgaagatctatggttgactaattaaacaataattcaagtagagtgtcccagaaaaaaaccacttgggctccctgattggagtctggctggctctgagcattgccaatggcccctactcacctgactttgtatcctcttcttttagaggctttgcattctgcacccagcttcactaacagtgggctgaaaccaaccttgggttgagtgtttcatttgggagttatttggccagggccttttgaacaatagtgtccccatgaagtgctagataatatatgtgtaagaatcagcttttttttttttaactataatatccttcagaaatttctaactactttgtaactgcatggcttaacctggtgataaaagcagttattaaaagtctacatttttttttaaaaaaaga

SEQ ID NO: 863 - DNA, 3025 bp, Homo sapiens
gacgccccgccggcgcgcgctgccgccagcgaggcccggggaggccgcggcggaggcggaggcccggcgccctgggcggcgccctgtccccgaagtccgtcctccccgttaggtggcgagcgcccgaggggaggggacagccgggcaagcaggaagctgcggcttaaaagggcaacccgcgcgggacccttcctccctagtcgcggggagtctgagaaagcgcgcctgtttcgcgaccatcacgcacctcccctccgcttgtggccatgtaccgctacctgggcgaagcgctgttgctgtcccgggccgggcccgctgccctgggctcggcgtccgccgactcggccgcgttgctgggctgggcccggggacagcccgccgccgccccgcagccggggctggcattggccgcccggcgccactacagcgaggcggtggccgaccgcgaggacgaccccaacttcttcaagatggtggagggcttcttcgatcgcggcgccagcatcgtggaggacaagctggtggaggacctgaggacccgggagagcgaggagcagaagcggaaccgggtgcgcggcatcctgcggatcatcaagccctgcaaccatgtgctgagtctctccttccccatccggcgcgacgacggctcctgggaggtcatcgaaggctaccgggcccagcacagccagcaccgcacgccctgcaagggaggtatccgttacagcactgatgtgagtgtagatgaagtaaaagctttggcttctctgatgacatacaagtgtgcagtggttgatgtgccgtttgggggtgctaaagctggtgttaagatcaatcccaagaactatactgataatgaattggaaaagatcacaaggaggttcaccatggagctagcaaaaaagggctttattggtcctggcattgatgtgcctgctccagacatgagcacaggtgagcgggagatgtcctggatcgctgatacctatgccagcaccatagggcactatgatattaatgcacacgcctgtgttactggtaaacccatcagccaagggggaatccatggacgcatctctgctactggccgtggtgtcttccatgggattgaaaatttcatcaatgaagcttcttacatgagcattttaggaatgacaccagggtttggagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggccgactgtgacatactgatcccagctgccagtgagaagcagttgaccaaatccaacgcacccagagtcaaagccaagatcattgctgaaggtgccaatgggccaacaactccagaagctgacaagatcttcctggagagaaacattatggttattccagatctctacttgaatgctggaggagtgacagtatcttactttgagtggctgaagaatctaaatcatgtcagctatggccgtttgaccttcaaatatgaaagggattctaactaccacttgctcatgtctgttcaagagagtttagaaagaaaatttggaaagcatggtggaactattcccattgtacccacggcagagttccaagacaggatatcgggtgcatctgagaaagacatcgtgcactctggcttggcatacacaatggagcgttctgccaggcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaagaaattaaggttagcggatcatgtacaagctgagtgtgaaagtagaaatcacctacaccagagagccattttggtattttgcctttaaataaaaagcctcctttatctggctagcagtcagttgcttgcttattttttctggatgagtctgggacacactgtaactttaacactttctgtttatgaatattattcttttagaatagaataagtacatgctgctgtaataaaattgcctttaatcacttaacaagcctaaccttgactcaaacagtgaatgcctatagaaataataaatgaaaaaaactagtatttttatatcataaaacaatgtcatttatagcttatcattcatgtattgtccagcagacattaaaagccctgtggataattaagttatcttcatacctgcaaaatggtggaggctattttcattaaaactgtcagaatttgcttactataattatgatacagtccaaagaatgcagtcactttttatcatgttaactaattgttctcttttgaagatctatggttgactaattaaacaataattcaagtagagtgtcccagaaaaaaaccacttgggctccctgtttggagtctggctggctctgagcattgccaatggcccctactcacctgactttgtatcctctccttttagaggctttgcattctgcacccagcttcactaacagtgggctgaaaacatccttgggttgagtgtttcatttgggagttatttggccagggccttttgaacagtagtgtccccatgaagtgctagataatatatgtgtaagagtcagctttttttttttttttaactctaacacccttcagaaatttctaactactttgtaactgcatggcttaacctggtgataaaagcagttattaaaagtctacgttttccaaaa

SEQ ID NO: 864 - DNA, 3384 bp, Homo sapiens
ggcgccgtacgtgcgcgcgcgcggcggcccagaaagcggcgctgggaccctgaggcggccgtggttaggcggctccccggcggctcctccgcggcggtgacggcgaccgcactccccgcttcccgctccccgcgctcctccgcccgggtccgccagccgaggccgctcccgagcgtcggaagatgccggccgtgtccaagggggacgggatgcggggcctggcggtcttcatgctcggatatccgcaactgtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgctcaatgaccagcacttgggtgtggtaactgcagccacaagtctgatcaccactttagcacagaagaacccagaagagtttaaaacctccgtgtctctggctgtctctaggctaagcagaatcgtgacgtctgcatccacagatctccaggattacacttactattttgtcccggctccctggctgtctgtcaaactgctgagactgctgcagtgctacccacccccagaagaccctgcagtgcgaggccgcctgactgagtgcctggagaccatcctgaacaaagcccaagaaccgcccaagtcgaagaaggtccagcactccaacgcgaagaatgccgtgctcttcgaggccatcagcttaatcattcaccatgacagtgagccgaacctgctcgtccgtgcctgcaaccagttgggccagtttctgcagcaccgcgagaccaacctgcgctacctggccctggagagcatgtgcacgctggccagctctgagttctcccatgaggctgtcaagacgcacatcgagacggtcatcaacgccctgaaggcgaactgagcgggacgtgagcgtgcggcagcgggccgtggacctcctctacgccatgtgcgaccgcagcaacgccccacagatcgtggccgagatgctgagctatctggagacagctgactactccatccgagaagagattgtgctgaaggtcgccatcctggctgagaagtacgcggtggactacacctggtatgtggataccatcttgaacttgatccgaattgctggtgattacgtgagtgaagaggtgtggtaccgagtcattcagatcgtcatcaaccgggacgacgtgcagggctacgcggccaagactgtgttcgaggctcttcaggctcccgcgtgccacgagaacctggtcaaagtgggcggctacatcctgggggagtttggaaacttgatagctggagacccgagatccagcccgctgatccagttccacctgctgcactccaagttccacctgtgcagcgtccccacccgcgcgctgctcctgtccacctacatcaagttcgtgaacctcttcccggaggtgaagcccaccatccaggacgtgctgcgcagcgacagccagctcaggaacgcagacgtggagctgcagcagcgtgctgtggagtacctgcggctcagcaccgtggccagcaccgacattctggcgaccgtgctggaggagatgcccccattcccggagcgggagtcctccatcttggcaaagctcaagaagaagaagggccccagcacggtgacagacctggaggacaccaagcgggacaggagtgtggacgtgaacgggggtcctgagcctgccccagccagtaccagcgccgtgtctacgccttctccgtcggcagacctgctgggtctcggggctgccccccctgcccccgcgggccccccaccctcctccggcggcagcgggctgctcgtggacgtgttctcagactcggcctctgtggtcgcgcctctcgctcctggctccgaagacaactttgccaggtttgtttgtaaaaacaatggtgtgttgtttgaaaaccagctgcttcaaattggacttaagtctgaatttcggcagaatttaggtcggatgtttatcttttatggtaataagacctccacgcagttcctaaactttaccccaacactaatctgttcagacgaccttcagcctaatatcctggattccttaacgcacgcacacctgaacctgcagaccaagcccgtggacccgaccgtggaggggggcgcgcaggtgcagcaggtggtcaacatagagtgcgtgtccgacttcacggaggcgccagtcctcaacattcagttcaggtatgggggcaccttccagaacgtgtctgtgcagctgcccatcactctcaacaaattcttccagccgacagaaatggcttctcaggatttctttcaacgttggaagcagttgagcaatccacagcaggaagtgcagaacatcttcaaagcaaagcacccaatggacacagaagtcaccaaagccaagatcattggatttggttctgcacttcttgaagaagttgatcctaatcctgcgaatttcgtgggagctggaatcatccacacgaaaaccacccagattggatgcctgctgcgcttggagccgaacctgcaagcccagatgtaccggctcacgctgcgcacaagtaaggaagccgtttctcagagattatgtgaattgctctcagcgcagttttagtcctgaggatggaagaccaggctcgtgtgtcttgtgttgtcttcgtctgtgccgtttgtcttcgtggccatccttgtggctcaggaggaaaagctcagcctggactgtggcagccacggcagaaggtggatcttgggatcaatttttataaaaatcgagacagttctgtggttaaatctacaaattaaagggaaattagaagttggcgtgaacgtggcgtttgtgggagtgtcactgagatggcccgtgctgccgctgctccccgaggcaccgcttccctgtgcggcgctgcagaggggccctcagtgtggcactcctcgtcaaagaaaaataaaggctagaactgc

SEQ ID NO: 865 - DNA, 3275 bp, Homo sapiens
ctgggaccctgaggcggccgtggttaggcggctccccggcggctcctccgcggcggtgacggcgaccgcactccccgcttcccgctccccgcgctcctccgcccgggtccgccagccgaggccgctcccgagcgtcggaagatgccggccgtgtccaagggggacgggatgcggggcctggcggtcttcatctcggatatccgcaactgtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgctcaatgaccagcacttgggtgtggtaactgcagccacaagtctgatcaccactttagcacagaagaacccagaagagtttaaaacctccgtgtctctggctgtctctaggctaagcagaatcgtgacgtctgcatccacagatctccaggattacacttactattttgtcccggctccctggctgtctgtcaaactgctgagactgctgcagtgctacccacccccagaccctgcagtgcgaggccgcctgactgagtgcctggagaccatcctgaacaaagcccaagaaccgcccaagtcgaagaaggtccagcactccaacgcgaagaatgccgtgctcttcgaggccatcagcttaatcattcaccatgacagtgagccgaacctgctcgtccgtgcctgcaaccagttgggccagtttctgcagcaccgcgagaccaacctgcgctacctggccctggagagcatgtgcacgctggccagctctgagttctcccatgaggctgtcaagacgcacatcgagacggtcatcaacgccctgaagactgagcgggacgtgagcgtgcggcagcgggccgtggacctcctctacgccatgtgcgaccgcagcaacgccccacagatcgtggccgagatgctgagctatctggagacagctgactactccatccgagaagagattgtgctgaaggtcgccatcctggctgagaagtacgcggtggactacacctggtatgtggataccatcttgaacttgatccgaattgctggtgattacgtgagtgaagaggtgtggtaccgagtcattcagatcgtcatcaaccgggacgacgtgcagggctacgcggccaagactgtgttcgaggctcttcaggctcccgcgtgccacgagaacctggtcaaagtgggcggctacatcctgggggagtttggaaacttgatagctggagacccgagatccagcccgctgatccagttccacctgctgcactccaagttccacctgtgcagcgtccccacccgcgcgctgctcctgtccacctacatcaagttcgtgaacctcttcccggaggtgaagcccaccatccaggacgtgctgcgcagcgacagccagctcaggaacgcagacgtggagctgcagcagcgtgctgtggagtacctgcggctcagcaccgtggccagcaccgacattctggcgaccgtgctggaggagatgcccccattcccggagcgggagtcctccatcttggcaaagctcaagaagaagaagggccccagcacggtgacagacctggaggacaccaagcgggacaggagtgtggacgtgaacgggggtcctgagcctgccccagccagtaccagcgccgtgtctacgccttctccgtcggcagacctgctgggtctcggggctgccccccctgcccccgcgggccccccaccctcctccggcggcagcgggctgctcgtggacgtgttctcagactcggcctctgtggtcgcgcctctcgctcctggctccgaagacaactttgccaggtttgtttgtaaaaacaatggtgtgttgtttgaaaaccagctgcttcaaattggacttaagtctgaatttcggcagaatttaggtcggatgtttatcttttatggtaataagacctccacgcagttcctaaactttaccccaacactaatctgttcagacgaccttcagcctaacctgaacctgcagaccaagcccgtggacccgaccgtggaggggggcgcgcaggtgcagcaggtggtcaacatagagtgcgtgtccgacttcacggaggcgccagtcctcaacattcagttcaggtatgggggcaccttccagaacgtgtctgtgcagctgcccatcactctcaacaaattcttccagccgacagaaatggcttctcaggatttctttcaacgttggaagcagttgagcaatccacagcaggaagtgcagaacatcttcaaagcaaagcacccaatggacacagaagtcaccaaagccaagatcattggatttggttctgcacttcttgaagaagttgatcctaatcctgcgaatttcgtgggagctggaatcatccacacgaaaaccacccagattggatgcctgctgcgcttggagccgaacctgcaagcccagatgtaccggctcacgctgcgcacaagtaaggaagccgtttctcagagattatgtgaattgctctcagcgcagttttagtcctgaggatggaagaccaggcttgtgtgtcttgtgttgtcttcgtctgtgccgtttgtcttcgtggccatcctgcagatgagcaccgtgtccagtgccacagcacaaggcgcctccccgccccgccgccccacacctctcccctttgggctggacgggaacacacgtgtgtggctcaggaggaaaagctcagcctggactgtggcagccacggcagaaggtggatcttgggatcaatttttataaaaatcgagacagttctgtggttaaatctacaaattaaagggaaattagaaaaaaaaaaaaaaaaaaaa

SEQ ID NO: 866 - DNA, 3446 bp, Homo sapiens
gttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaacttagcattaccttggtgctctgtgttctctgttagctcagtgtctttccttacatcaataggtttttttttttttttttggcctgaggaagtactgaccatgcccacagccaccggctgagcaaagaagctcatttcatgtgagttctaaggaatgagaaacaattttgatgaatttaagcagaaaatgaatttctgggaacttttttgggggcgggggggtggggaattcagccacactccagaaagccaggagtcgacagttttggaagcctctctcaggattgagattctaggatgagattggcttactgctatcttgtgtcatgtacccactttttggccagactacactgggaagaaggtagtcctctaaagcaaaatctgagtgccactaaatggggagatggggctgttaagctgtccaaatcaacaagggtcatataaatggccttaaactttggggttgctttctgcaaaaagttgctgtgactcatgccatagacaaggttgagtgcctggacccaaaggcaatactgtaatgtaaagacatttatagtactaggcaaacagcaccccaggtactccaggccctcctggctggagagggctgtggcaatagaaaattagtgccaactgcagtgagtcagcctaggttaaatagagagtgtaagagtgctggacaggaacctccaccctcatgtcacatttcttcaatgtgacccttctggcccctctcctcctgacagcggaacaatgactgccccgataggtgaggctggaggaagaatcagtcctgtccttggcaagctcttcactatgacagtaaaggctctctgcctgctgccaaggcctgtgactttctaacctggcctcacgctgggtaagcttaaggtagaggtgcaggattagcaagcccacctggctaccaggccgacagctacatcctccaactgaccctgatcaacgaagagggattcatgtgtctgtctcagttggttccaaatgaaaccagggagcaggggagttaggaatcgaacaccagtcatgcctactggctctctgctcgagagccaataccctgtgccctccactcatctggatttacaggaactgtcatagtgttcagtattgggtggtgataagcccattggattgtccccttggggggatgagctaggggtgcaaggaacacctgatgagtagataagtggagctcatggtatttcctgaaagatgctaatctatttgccaaacttggtcttgaatgtactgggggcttcaaggtatgggtatatttttcttgtgtccttgcagttagcccccatgtcttatgtgtgtcctgaaaaaataagagcctgcccaagactttgggcctcttgacagaattaaccacttttatacatctgagttctcttggtaagttctttagcagtgttcaaagtctactagctcgcattagtttctgttgctgccaacagatctgaactaatgctaacagatccccctgagggattcttgatgggctgagcagctggctggagctagtactgactgacattcattgtgatgagggcagctttctggtacaggatt

SEQ ID NO: 867 - DNA, 5069 bp, Homo sapiens
cgggctggagcgaaagaatgcgggggctgagcgcagaagcggctcgaggctggaagaggatcttgggcgccgccaggttctgtggacaatcacaatgggaatccaaggagggtctgtcctgttcgggctgctgctcgtcctggctgtcttctgccattcaggtgagtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaacttagcattaccttggtgctctgtgttctctgttagctcagtgtctttccttacatcaataggtttttttttttttttttggcctgaggaagtactgaccatgcccacagccaccggctgagcaaagaagctcatttcatgtgagttctaaggaatgagaaacaattttgatgaatttaagcagaaaatgaatttctgggaacttttttgggggcgggggggtggggaattcagccacactccagaaagccaggagtcgacagttttggaagcctctctcaggattgagattctaggatgagattggcttactgctatcttgtgtcatgtacccactttttggccagactacactgggaagaaggtagtcctctaaagcaaaatctgagtgccactaaatggggagatggggctgttaagctgtccaaatcaacaagggtcatataaatggccttaaactttggggttgctttctgcaaaaagttgctgtgactcatgccatagacaaggttgagtgcctggacccaaaggcaatactgtaatgtaaagacatttatagtactaggcaaacagcaccccaggtactccaggccctcctggctggagagggctgtggcaatagaaaattagtgccaactgcagtgagtcagcctaggttaaatagagagtgtaagagtgctggacaggaacctccaccctcatgtcacatttcttcaatgtgacccttctggcccctctcctcctgacagcggaacaatgactgccccgataggtgaggctggaggaagaatcagtcctgtccttggcaagctcttcactatgacagtaaaggctctctgcctgctgccaaggcctgtgactttctaacctggcctcacgctgggtaagcttaaggtagaggtgcaggattagcaagcccacctggctaccaggccgacagctacatcctccaactgaccctgatcaacgaagagggattcatgtgtctgtctcagttggttccaaatgaaaccagggagcaggggagttaggaatcgaacaccagtcatgcctactggctctctgctcgagtggtgataagcccattggattgtccccttggggggatgagctaggggtgcaaggaacacctgatgagtagataagtggagctcatggtatttcctgaaagatgctaatctatttgccaaacttggtcttgaatgtactgggggcttcaaggtatgggtatatttttcttgtgtccttgcagttagcccccatgtcttatgtgtgtcctgaaaaaataagagcctgcccaagactttgggcctcttgacagaattaaccacttttatacatctgagttctcttggtaagttctttagcagtgttcaaagtctactagctcgcattagtttctgttgctgccaacagatctgaactaatgctaacagatccccctgagggattcttgatgggctgagcagctggctggagctagtactgactgacattcattgtgatgagggcagctttctggtacaggattctaagctctatgttttctatacattttcatctgtacttgcacctcactttacacaagaggaaactatgcaaagttagctggatcgctcaaggtcacttaggtaagttggcaagtccatgcttcccactcagctcctcaggtcagcaagtctacttctctgcctattttgtatactctctttaatatgtgcctagctttggaaagtctagaatgggtccctggtgcctttttactttgaagaaatcagtttctgcctctttttggaaaagaaaacaaagtgcaattgttttttactggaaagttacccaatagcatgaggtgaacaggacgtagttaggccttcctgtaaacagaaaatcatatcaaaacactatcttcccatctgtttctcaatgcctgctacttcttgtagatatttcatttcaggagagcagcagttaaacccgtggattttgtagttaggaacctgggttcaaaccctcttccactaattggctatgtctctggacaagtttttttttttttttttttttaaaccctttctgaactttcactttctatgtctacctcaaagaattgttgtgaggcttgagataatgcatttgtaaagggtctgccagataggaagatgctagttatggatttacaaggttgttaaggctgtaagagtctaaaacctacagtgaatcacaatgcatttacccccactgacttggacataagtgaaaactagccagaagtctctttttcaaattacttacaggttattcaatataaaatttttgtaatggataatcttatttatctaaactaaagcttcctgtttatacacactcctgttattctgggataagataaatgaccacagtaccttaatttctaggtgggtgcctgtgatggttcattgtaggtaaggacattttctctttttcagcagctgtgtaggtccagagcctctgggagaggaggggggtagcatgcacccagcaggggactgaactgggaaactcaaggttctttttactgtggggtagtgagctgcctttctgtgatcggtttccctagggatgttgctgttcccctccttgctattcgcagctacatacaacgtggccaaccccagtaggctgatcctatatatgatcagtgctggtgctgactctcaatagccccacccaagctggctataggtttacagatacattaattaggcaacctaaaatattgatgctggtgttggtgtgacataatgctatggccagaactgaaacttagagttataattcatgtattagggttctccagagggacagaattagtaggatatatgtatatatgaaagggaggttattagggagaactggctcccacagttagaaggcgaagtcgcacaataggccgtctgcaagctgggttagagagaagccagtagtggctcagcctgagttcaaaaacctcaaaactggggaagctgacagtgcagccagccttcagtctgtggccaaaggcccaagagcccctggcaaccaacccactggtgcaagtcctagattccaaaggctgaagaacctggagtctgatgtccaagagcaggaagagtggaagaaa

SEQ ID NO: 868 - DNA, 524 bp, Homo sapiens
aagcttcctaattgcacagttagatggatattcaaatgtggatatttcctttgtgcttgcatcagggtccaaaaatgttgctggaactgtagtttgaatttggaaagatataactgctatacatttgtgcgggagtggaatgataccacaagttgctgactttgggcccatattaatggagatggtgggctgccaggggacaagtcagtgctgctttaagagatcctgactttcttcctgattctaggtcatagcctgcagtgctacaactgtcctaacccaactgctgactgcaaaacagccgtcaattgttcatctgattttgatgcgtgtctcattaccaaagctggtaagagcctcccctgtctgtctcctaaatgtaatggggtaataagtgcctgggaaaaaaattgtgccactgtaatcctcattaggcttgcatcaagtaatagctaccatttattagcgtcaggtgtgtattgggctaagcacttcttcatacattttaaatttaatgttttgca

SEQ ID NO: 869 - DNA, 3653 bp, Homo sapiens
gcgcagaagcggctcgaggctggaagaggatcttgggcgccgccagtctctctctgttgcccaagctggagtgcagtggcacagtcttggctcactgcaacctccacctcctgggtgcaagcgattctcgtgtctcagcctctcaagtagctgggattacagtctttagcaccagttggtgtaggagttgagacctacttcacagtagttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaacttagcattaccttggtgctctgtgttctctgttagctcagtgtctttccttacatcaataggtttttttttttttttttggcctgaggaagtactgaccatgcccacagccaccggctgagcaaagaagctcatttcatgtgagttctaaggaatgagaaacaattttgatgaatttaagcagaaaatgaatttctgggaacttttttgggggcgggggggtggggaattcagccacactccagaaagccaggagtcgacagttttggaagcctctctcaggattgagattctaggatgagattggcttactgctatcttgtgtcatgtacccactttttggccagactacactgggaagaaggtagtcctctaaagcaaaatctgagtgccactaaatggggagatggggctgttaagctgtccaaatcaacaagggtcatataaatggccttaaactttggggttgctttctgcaaaaagttgctgtgactcatgccatagacaaggttgagtgcctggacccaaaggcaatactgtaatgtaaagacatttatagtactaggcaaacagcaccccaggtactccaggccctcctggctggagagggctgtggcaatagaaaattagtgccaactgcagtgagtcagcctaggttaaatagagagtgtaagagtgctggacaggaacctccaccctcatgtcacatttcttcaatgtgacccttctggcccctctcctcctgacagcggaacaatgactgccccgataggtgaggctggaggaagaatcagtcctgtccttggcaagctcttcactatgacagtaaaggctctctgcctgctgccaaggcctgtgactttctaacctggcctcacgctgggtaagcttaaggtagaggtgcaggattagcaagcccacctggctaccaggccgacagctacatcctccaactgaccctgatcaacgaagagggattcatgtgtctgtctcagttggttccaaatgaaaccagggagcaggggagttaggaatcgaacaccagtcatgcctactggctctctgctcgagagccaataccctgtgccctccactcatctggatttacaggaactgtcatagtgttcagtattgggtggtgataagcccattggattgtccccttggggggatgagctaggggtgcaaggaacacctgatgagtagataagtggagctcatggtatttcctgaaagatgctaatctatttgccaaacttggtcttgaatgtactgggggcttcaaggtatgggtatatttttcttgtgtccttgcagttagcccccatgtcttatgtgtgtcctgaaaaaataagagcctgcccaagactttgggcctcttgacagaattaaccacttttatacatctgagttctcttggtaagttctttagcagtgttcaaagtctactagctcgcattagtttctgttgctgccaacagatctgaactaatgctaacagatccccctgagggattcttgatgggctgagcagctggctggagctagtactgactgacattcattgtgatgagggcagctttctggtacaggatt

SEQ ID NO: 870 - DNA, 1606 bp, Homo sapiens
cgcgcgcgcagcatggcgcccccgcaggtcctcgcgttcgggcttctgcttgccgcggcgacggcgacttttgccgcagctcaggaaggtgaggcgcggattggagcagagttgtggagctgggctgggctggggggcagcggcccccggccctcggcccccgaaacgggcataatagggaggggaccaagaggccgcgctttccagcgtggagaccggacggtgcggccgtgctccggctcaggccctccgcgcggtaggaaacggcgagggccgtcccggggagcagcctcacttcgcagctttgctcgccttgaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccatgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattctcaatgcagggtctaaaagctggtgttattgctgttattgtggttgtggtgatagcagttgttgctggaattgttgtgctggttatttccagaaagaagagaatggcaaagtatgagaaggctgagataaaggagatgggtgagatgcatagggaactcaatgcataactatataatttgaagattatagaagaagggaaatagcaaatggacacaaattacaaatgtgtgtgcgtgggacgaagacatctttgaaggtcatgagtttgttagtttaacatcatatatttgtaatagtgaaacctgtactcaaaatataagcagcttgaaactggctttaccaatcttgaaatttgaccacaagtgtcttatatatgcagatctaatgtaaaatccagaacttggactccatcgttaaaattatttatgtgtaacattcaaatgtgtgcattaaatatgcttccacagtaaaatctgaaaaactgatttgtgattgaaagctgcctttctatttacttgagtcttgtacatacatacttttttatgagctatgaaataaaacattttaaactgaatttcttaactttga

SEQ ID NO: 871 - DNA, 1651 bp, Homo sapiens
caccagcggccagaggtgagcagtcccgggaaggggccgagaggcggggccgccaggtcgggcaggtgtgcgctccgccccgccgcgcgcacagagcgctagtccttcggcgagcgagcaccttcgacgcggtccggggaccccctcgtcgctgtcctcccgacgcggacccgcgtgccccaggcctcgcgctgcccggccggctcctcgtgtcccactcccggcgcacgccctcccgcgagtcccgggcccctcccgcgcccctcttctcggcgcgcgcgcagcatggcgcccccgcaggtcctcgcgttcgggcttctgcttgccgcggcgacggcgacttttgccgcagctcaggaagaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccatgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattctcaatgcagggtctaaaagctggtgttattgctgttattgtggttgtggtgatagcagttgttgctggaattgttgtgctggttatttccagaaagaagagaatggcaaagtatgagaaggctgagataaaggagatgggtgagatgcatagggaactcaatgcataactatataatttgaagattatagaagaagggaaatagcaaatggacacaaattacaaatgtgtgtgcgtgggacgaagacatctttgaaggtcatgagtttgttagtttaacatcatatatttgtaatagtgaaacctgtactcaaaatataagcagcttgaaactggctttaccaatcttgaaatttgaccacaagtgtcttatatatgcagatctaatgtaaaatccagaacttggactccatcgttaaaattatttatgtgtaacattcaaatgtgtgcattaaatatgcttccacagtaaaatctgaaaaactgatttgtgattgaaagctgcctttctatttacttgagtcttgtacatacatacttttttatgagctatgaaataaaacattttaaactgaatttcttaactttga

SEQ ID NO: 872 - DNA, 1504 bp, Homo sapiens
gagcgagcaccttcgacgcggtccggggaccccctcgtcgctgtcctcccgacgcggacccgcgtgccccaggcctcgcgctgcccggccggctcctcgtgtcccactcccggcgcacgccctcccgcgcccctcttctcggcgcgcgcgcagcatggcgcccccgcaggtcctcgcgttcgggcttctgcttgccgcggcgacggcgacttttgccgcagctcaggaagaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccacgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattctcaatgcagggtctaaaagctggtgttattgctgttattgtggttgtggtgatggcagttgttgctggaattgttgtgctggttatttccagaaagaagagaatggcaaagtatgagaaggctgagataaaggagatgggtgagatgcatagggaactcaatgcataactatataatttgaagattatagaagaagggaaatagcaaatggacacaaattacaaatgtgtgtgcgtgggacgaagacatctttgaaggtcatgagtttgttagtttaacatcatatatttgtaatagtgaaacctgtactcaaaatataagcagcttgaaactggctttaccaatcttgaaatttgaccacaagtgtcttatatatgcagatctaatgtaaaatccagaacttggactccatcgttaaaattatttatgtgtaacattcaaatgtgtgcattaaatatgcttccacagtaaaatctgaaaaactgatttgtgattgaaagctgcctttctatttacttgagtcttgtacatacatacttttttatgagctatgaaataaaacattttaaactg

SEQ ID NO: 873 - DNA, 1045 bp, Homo sapiens
actatccggcgccgagccggaggggggaaacggcgcccgccgcccgcccggagcccgcgagcaaccccagtcccccccacccgcgcgtggcggcgccggctccctagccaccgcggccccaccctcttccggcctcagctgtccgggctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggtttttttttttttaatataaaaaaaaaaaaaaaaaa

SEQ ID NO: 874 - DNA, 1598 bp, Homo sapiens
gaaacggcgcccgccgcccgcccggagcccgcgagcaaccccagtcccccccacccgcgcgtggcggcgccggctccctagccaccgcggccccaccctcttccggcctcagctgtccgggctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggttttttttttttttaatatataatgtgtgggcctggttcttgagcctgcagcacctcccctaggcctacatcccaacatgcctgcaactctcctgtggcaatgggtgcctgccccttccctgggatcctgcctgaaattttgacccaggagctacccaggaaaagtcaggcaggagcttttgccccctgcttctaaactttgccagctactgggcctccacatttgctccccttgccaccaccctccagtctatgttaagggatgtatctgtactttttcatagcctacctctaaattgattttttttttttttttggtagagacaggtctcactatgttgcgctggctggtctcaaacttccagacccaagcatcctcctgccttggcctcctaaagtattgggattacaggcatgagcctctgcacccagctgacttcttcctttattatttatttattttgagacggagtttcactcttgttgcccaggctggagtgcagtggcgcgatctcggctcaccacaacttccgcctcctggcttcaagagattctcctgccttgggccgggcgcggtggctcacgcctgtaatcccagcactttgggaggccgag

SEQ ID NO: 875 - DNA, 833 bp, Homo sapiens
gaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctctttggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggtttttttttttaataaaag

SEQ ID NO: 876 - DNA, 1548 bp, Homo sapiens
gaaacggcgcccgccgcccgcccggagcccgcgagcaaccccagtcccccccacccgcgcgtggcggcgccggctccctagccaccgcggccccaccctcttccggcctcagctgtccgggctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggttttttttttttttaatatataatgtgtgggcctggttcttgagcctgcagcacctcccctaggcctacatcccaacatgcctgcaactctcctgtggcaatgggtgcctgccccttccctgggatcctgcctgaaattttgacccaggagctacccaggaaaagtcaggcaggagcttttgccccctgcttctaaactttgccagctactgggcctccacatttgctccccttgccaccaccctccagtctatgttaagggatgtatctgtactttttcatagcctacctctaaattgattttttttttttttttggtagagacaggtctcactatgttgcgctggctggtctcaaacttccagacccaagcatcctcctgccttggcctcctaaagtattgggattacaggcatgagcctctgcacccagctgacttcttcctttattatttatttattttgagacggagtttcactcttgttgcccaggctggagtgcagtggcgcgatctcggctcaccacaacttccgcctcctggcttcaagagattctcctgccttgg

SEQ ID NO: 877 - DNA, 8878 bp, Homo sapiens
gaattcatgccccttttgaaatagacttatgtcattgtcagaaaacataagcatttatggtatatcattaatgagtcacgattttagtggttgccttgtgagtaggtcaaatttactaagcttagatttgttttctcacatattctttcggagcttgtgtagtttccacattaatttaccagaaacaagatacacactctctttgaggagtgccctaacttcccatcattttgtccaattaaatgaattgaagaaatttaatgtttctaaactagaccaacaaagaataatagttgtatgacaagtaaataagctttgctgggaagatgttgcttaaatgataaaatggttcagccaacaagtgaaccaaaaattaaatattaactaaggaaaggtaaccatttctgaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggaggtgaattttttaaagcattattatattattagtagtattattaatataagatgtaacataatcatattatgtgcttattttaatgaaattagcattgcttatagttatgaaatggaattgttaacctctgacttattgtatttaaagaatgtttcatagtatttcttatataaaaacaaagtaatttcttgttttctagtttatcacctttgttttcttaagatgaggatggcttagctaatgtaagatgtgtttttctcacttgctattctgagtactgtgattttcatttacttctagcaatacaggattacaattaagaggacaagatctgaaaatctcacaaactataaaataataaaagagcagaattttaagataaaagaaactggtggtaggtagattgttctttggtgaaggaaggtaatatatattgttactgagattactatttataaaaattataactaagcctaaaagcaaaatacatcaagtgtaatgatagaaaatgaaatattgcttttttcagatgaaaagttcaaattagagttagtgtgtattgttattattaatagttatgaaacacggttcagtctaatttatttatttgtagaacagtttgtcctcaactattatttttgctgacttattgctgttaatttgcagttactaaaaatacagaaatgcatttaggacaatggatatttaagaaatttaaattttatcatcaaacgtatcatggccaaatttcttacatatagcatagtatcattaaactagaaataagaatacacaataatatttaaatgaagtgattcatttcggatcattattgagtttcaagggaacttgagtgttgtacttatcagactctacatgtaagaacatatagttaatctggttgtgtgtgtaaaaacatatggttaatctggttaagtctggttaatcatattaggtaagaaaaatgtaaagaatgtgtaagacgaaatttttgtaaagtactctgcaaagcactttcacatttctgcttatcaactaaacctcacagagatagtttaatagtttaggctttaaaatggattttgattattcaacaagtggccttcataatttctttaagtgtttttctttaagtatatactttctttaaatattttttaaaatttccttttctctagtaaagccagaccatccatgctacctctctagtggcactctgaaataaaaagaaaatagttttctctgttataattgtatttgtaataagcagatgaatcacatttcttaaaatttgttttagagagggtaagctctgactaggaccatgacttcaatgtgaaatatgtatatatcctccgaatctttacatattaagaatgtatatagtcaactggttaaacaggaaaatctggaacagcctggctgggttttaatcttagcaccatcctactaaatgttaaataatattataatctaatgaataaatgacaatgcaattccaaatagagttcatctgatgacttctagactcacaaaattgcaagagagctcagttgttgctcagttgttccaaatcatgtcgtttgttaatttgtaattaagctccaaaggatgtatagctactgacaaaaaaaaaaatgagaatgtagttaatccaaatcaaaactttcctattgcaatgcgtattttctgcttcattatcctttaatataatattttaagttagcaagtaattttaattacaatgcacaagccttgagaattattttaaatataagaaaatcataatgtttgataaagaaatcatgtaagaaatttcaagataatggtttaacaaataattttgttgatagaagataagactaaaagtgaaattcgaagtggagaggacacttaaactgtagtacttgttatgtgtgattccagtaaaaatagtaatgagcacttattattgccaagtactgttctgagggtaccatatgcaataagttatttaatccttacaataatcttgtaaggcagattcaaactatcattacacttattttacagatgagaaaactggggcacagataaagcaacttgcccaaggtctcatagctgtaagtcaaccctacggtcaagacctacaagtagccgagctccagagtacattatgagggtcaaagattgtcttattacaaataaattccaagtagaatcaacctttaataagtctttaatgtctcttaaatatgtttatataggagtctaatcaccaattcacaaaaatgaaagtagggaaatgattaacaataatcataggaatctaacaatccaagtggcttgagaatattcattcttcttgacagtatagattctttacaatttcgtaagttccaatgtatgttttaggaatatgaggtcattactattcataatctgatacagctttatcctaaggcctctctttaaaaactacactgcatcatagcttttttgtgcagttggtctttctactgttactgaacagtaagcaacctacagattcactatcaccaaccagccagttgatggatcttaagcaaattatcaagcttgtgataacctaaattataaaatgagggtgttggaatagttacattccaaatcttctataacactctgtattatatttctgcctcattccttgtagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctggtgggtgcactgatgtttcttgcagtggtggctctctcatgcagagaaagcctgtagtcatggcagtctgctaatgtttcactgacccacattaccatcactgttattttgtttgtttattttggaaataaaattcaaaacataaacatattgggcctttggtttaggctttctttcttgttttctttggtctgggcccaaaatttcaaattaggatatgtgggtgccacctttccatttgtattttgccactgcctttgtttagttggtaaaattttcatagcccaattatattttttctggggtaagtaatattttaaatctctatgagagtatgatgatgactttcgaatttctggtcttacagaaaaccaaataataaatttttatgttggctaatcgtatcgctgaattttcctatgtgctattttaacaaatgtccatgacccaaatccttcatctaatgcctgctattttctttgtttttagggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaaggtagatatccttgtgctttccattcgattttcagctataaaattggaaccgttagactgccacgagaatgcatggttgtgagaagattaacatttctgggttagtgaatagcattcatacgcttttgggcaccttcccctgcaacttgccagataagcactattcagctcttattcccagtctgacatcagcaagtgtgattttctatgaaaaattctactatgactccttattttaagtatacaagaaacttgtgactcagaagataatatttacagagtggaaaaaaacccctagcatttatagttttaacatttgaggttttgaatgagagagttatccataatatattcaattgtgttgtggataatgacacctaacctgtgaatcttgaggtcagaatgttgagtgctgttgacttggtggtcaggaaacagctagtgcgtgagcctggcacaggcatctcagtgagtagcatacccacagttggaaatttttcaaagaaatcaaaggaatcatgacatcttataaatttcaaggttctgctatacttatgtgaaatggataaataaatcaagcatatccactctgtaagattgaacttctcagatggaagaccccaatactgctttctcctcttttccctcaccaaagaaataaacaacctatttcatttattactggacacaatctttagcgtatacctatggtaaattactagtatggtggttaggatttatgttaatttgtatatgtcatgcgccaaatcatttccactaaatatgactatatatcataactgcttggtgatagctcagtgtttaatagtttattctcagaaaatcaaaattgtatagttaaatacattagttttatgaggcaaaaatgctaactatttctacataatttcatttttccagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaaggtaactgattcataaacatatttttagagagttccagaagaactcacacaccaaaaataagagaacaacaacaacaacaaaaatgctaagtggattttcccaacagatcataatgacattacagtacatcataaaaatatccttagccagttgtgttttggactggcctggtgcatttgctggttttgatgagcaggatggggcacaggtagtcccaggggtggctgatgtgtgcatctgcgtactggcttgaacagatggcagaaccacagatagatgtagaagtttctccattttgtgtgttctgggagctcatggatattccaggacacaaaaggtggagaagagctttgttcatcctcttagcagataaacgtcctcaaaactgggttggacttactaaagtaaaatgaaaatctaatatttgttatattattttcaaaggtctataataacacactccttagtaacttatgtaatgttattttaaagaattggtgactaaatacaaagtaattatgtcataaacccctgaacataatgttgtcttacatttgcagaatgtgaggaaattatcaggaaaggaggtgaaacatctgaaatgtatctcattcaacctgacagttctgtcaaaccgtatagagtatactgtgacatgaatacagaaaatggaggtaagctttcgacagttgttgacctgttgatctgtaattatttggataccgtaaaatgccaggaaacaaggccaggtgtggtggctcatacctgtaattccagcaccttgggaggccaaagtgggctgatagcttgagcctaggagtttgaaactagcctgggcaacataatgagaccctaactctacaaaaaaaaaaaaaataccaaaaaaaaaaaaaaaatcagctgtgttggtagtatgtgcctgtagtcccagctatccaggaggctgagatgggagatcacctgagcccacaacctggagtcttgatcatgctactgaactgtagcctgggcaacagaggatagtgagatcctgtctcaaaaaaaaaaattaattaaaaagccaggaaacaagacttagctctaacatctaacatagctgacaaaggagtaatttgatgtggaattcaacctgatatttaaaagttataaaatatctataattcacaatttggggtaagataaagcacttgcagtttccaaagattttacaagtttacctctcatatttatttccttattgtgtctattttagagcaccaaatatatactaaatggaatggacaggggattcagatattattttcaaagtgacattatttgctgttggttaatatatgctctttttgtttctgtcaaccaaaggatggacagtgattcagaaccgtcaagacggtagtgttgactttggcaggaaatgggatccatataaacagggatttggaaatgttgcaaccaacacagatgggaagaattactgtggcctaccaggtaacgaacaggcatgcaaaataaaatcattctatttgaaatgggattttttttaattaaaaaacattcattgttggaagcctgttttaggcagttaagaggagtttcctgacaaaaatgtggaagctaaagataagggaagaaaggcagtttttagtttcccaaaattttatttttggtgagagattttattttgtttttcttttaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggtatgtgtggcactctttgctcctgctttaaaaatcacactaatatcattactcagaatcattaacaatatttttaatagctaccacttcctgggcacttactgtcagccactgtcctaagctctttatgcatcactcgaaagcatttcaactataaggtagacattcttattctcattttacagatgagatttagagagattacgtgatttgtccaatgtcacacaactacccagagataaaactagaatttgagcacagttactttctgaataatgagcatttagataaatacctatatctctatattctaaagtgtgtgtgaaaactttcattttcatttccagggttctctgatactaagggttgtaaaagctattattccagtataaagtaacaaacacagtccctagatggattgccacaaaggcccagttatctctctttcttgctatagggcacaggaggtctttggtgtattagtgtgactctatgtatagcacccaaaggaaagactactgtgcacacgagtgtagcagtcttttatgggtaatctgcaaaacgtaacttgaccaccgtagttctgtttctaataacgccaaacacattttctttcaggttaacatcagatcccagaaaacagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcacccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaataagttaatgttttcttgttttgtaatccacacattcaatgagttaggctttgcacttgtaaggaaggagaagcgttcacaacctcaaatagctaataaaccggtcttgaatatttgaagatttaaaatctgactctaggacgggcacggtggctcacgactataatcccaacactttgggaggctgaggcgggcggtcacaaggtcaggagttcaagaccagcctgaccaatatggtgaaaccccatctctactaaaaatacaaaaattagccaggcgtggtggcaggtgcctgtaggtcccagctagcctgtgaggtggagattgcattgagccaagatc

SEQ ID NO: 878 - DNA, 1716 bp, Homo sapiens
tgaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggttaacatcagatcccagaaaacagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaat

SEQ ID NO: 879 - DNA, 2543 bp, Homo sapiens
tgaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggttaacatcagatcccagaaaacagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggaagatgaatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaataagttaatgttttcttgttttgtaatccacacattcaatgagttaggctttgcacttgtaaggaaggagaagcgttcacaacctcaaatagctaataaaccggtcttgaatatttgaagatttaaaatctgactctaggacgggcacggtggctcacgactataatcccaacactttgggaggccgaggcgggcggtcacaaggtcaggagttcaagaccagcctgaccaatatggtgaaaccccatctctactaaaaatacaaaaattagccaggcgtggtggcaggtgcctgtagtcccagctacctgtgaggtggagattgcattgagccaagatctcaacactgcactccagcctgggcaacagcgtgagactccacctcaaaaaaaaaaaaaaaagaatctgactatataccatggaaaagccaccactctgccacttaaataaacatcaggatcagagattccaagaggacaatctgcatcaagtcttcaccaagtgttttttaagcgaaataatgaaatagggagcagaatatgcctgttgcccatagaaacgaggtctattcttgtcctcaattaggcttttttttcttcatagttacaccagaactaaa

SEQ ID NO: 880 - DNA, 3693 bp, Homo sapiens
tgaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggttaacatcagatcccagaaaacagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaataagttaatgttttcttgttttgtaatccacacattcaatgagttaggctttgcacttgtaaggaaggagaagcgttcacaacctcaaatagctaataaaccggtcttgaatatttgaagatttaaaatctgactctaggacgggcacggtggctcacgactataatcccaacactttgggaggccgaggcgggcggtcacaaggtcaggagttcaagaccagcctgaccaatatggtgaaaccccatctctactaaaaatacaaaaattagccaggcgtggtggcaggtgcctgtagtcccagctacctgtgaggtggagattgcattgagccaagatctcaacactgcactccagcctgggcaacagcgtgagactccacctcaaaaaaaaaaaaaaaagaatctgactatataccatggaaaagccaccactctgccacttaaataaacatcaggatcagagattccaagaggacaatctgcatcaagtcttcaccaagtgttttttaagcgaaataatgaaatagggagcagaatatgcctgttgcccatagaaacgaggtctattcttgtcctcaattaggcttttttttcttcatagttacaccagaactaaagtaaaagtggtttttctgttctttctacttctccccatgaaatgggcatatcatctcaacacttcactccaagtcgccacgggcaaccttatgaccctaggtcctccacccctaatgtatcatcattgccacccatttttatggtacttattgttcttaagcttatcctcttaatcttttcatgtaagcaaagctcattaatttctgtcttggaaatgctactactctctttaattactcaccaaatccaactttaacttttgacctggtttctctgccacaagttctgtcccactggagcccatactcacctaccgctttgccatcacatttaacagaaaactcttatcaacttacttcctgcttaacattagctccttcctatctatatccaaatttcttaaattcaaattttttagctggagtaaaaatggtcccagtaccatttcctgttcccttcactataacctacatttttgtcacattaagtttttccccattccaggacaggtcaggccctttaaaaatttcaacagctttattgagatataattgatataatttaaaaaatcctgcacatgtgtcatgctggagccctattgattccaacagggatggcgccttgtccaagaagagacccagagccagtgaatgggacatagggtttatttaggacttaaatacagatgtggtccagtggcagtgggctggacaggaccgctactatttgtaaagagtatgtagtttatataacatttctacttagcactctccacttagcaacctccatttaacccaaaataaaaggccttggttccttgcacatcctgagttccaacggacaggcagggagttcaagtgtccttcacagataagaagtgaatctctctgggttggccattcccggattccttagcttagactctgaacacatattcttcttagaccatacagtcattctcagggtatgcttgagttaatgctgtcggatgcatctgtcatacaaagtgtttaacatatacgatttcatgattttggaaatatgcatacacccatgatatcactggcacagtcaagatattaaatatatccatcacctcc

SEQ ID NO: 881 - DNA, 1864 bp, Homo sapiens
agtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaattgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggttaacatcagatcccagaaaacagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaat

SEQ ID NO: 882 - DNA, 1882 bp, Homo sapiens
tgaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccacccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggagggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggttaacatcagatcccagaaaacagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaat

SEQ ID NO: 883 - DNA, 1907 bp, Homo sapiens
agtaagcaacctacagattcactatcaccaaccagccagttgatggatcttaagcaaattatcaagcttgtgataacctaaattataaaatgagggtgttggaatagttacattccaaatcttctataacactctgtattatatttctgcctcattccttgtagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaattgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggttaacatcagatcccagaaaacagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaat

SEQ ID NO: 884 - DNA, 1797 bp, Homo sapiens
tgaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggttaacatcagatcccagaaaacagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaat

SEQ ID NO: 885 - DNA, 1918 bp, Homo sapiens
aagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcgcaactaaccttcgtgtgcttcgttcaatcctagaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggttaacatcagatcccagaaaacagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaat

SEQ ID NO: 886 - DNA, 1485 bp, Homo sapiens
tgaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggttaacatcagatcccagaaaacaccaatccaaacggcagatactactggggtggacagtacacctgggacatggcaaagcatggcacagatgatggtgtagtatggatgaattggaaggggtcatggtactcaatgaggaagatgagtatgaagatcaggcccttcttcccacagc

SEQ ID NO: 887 - DNA, 1839 bp, Homo sapiens
ggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaattgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggttaacatcagatcccagaaaacagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaat

SEQ ID NO: 888 - DNA, 3163 bp, Homo sapiens
gggaggctggggatggcgcgtggcccctttaagacgcaccggggcgggcccgggcggcgcgcggcccctttaaggcttggcctacgtggcagccgctggagccgcagccgacgcggagcgaggccggccgccgggcacttcctgtggaggccgcagcgggtgcgggcgccgacgggcgagagccagcgagcgagcgagcgagccgagccgagcctcccgccgtcgccatgggccagaacgacctgatgggcacggccgaggacttcgccgaccagcgtctgttcctcacacaccccgcccaaggacgtgcctggcagcggcctggtgctccccgccgcagccacctcacccttgggtttctgtggccctgcagttcctccgtgtcacaaagcagtacctgccccacgtggcgcgcctctgtctgatcagcaccttcctggaggacggcatccgtatgtggttccagtggagcgagcagcgcgactacatcgacaccacctggaactgcggctacctgctggcctcgtccttcgtcttcctcaacttgctgggacagctgactggctgcgtcctggtgttgagcaggaacttcgtgcagtacgcctgcttcgggctctttggaatcatagctctgcagacgattgcctacagcattttatgggacttgaagtttttgatgaggaacctggccctgggaggaggcctgttgctgctcctagcagaatcccgttctgaagggaagagcatgtttgcgggcgtccccaccatgcgtgagagctcccccaaacagtacatgcagctcggaggcagggtcttgctggttctgatgttcatgaccctccttcactttgacgccagcttcttttctattgtccagaacatcgtgggcacagctctgatgattttagtggccattggttttaaaaccaagctggctgctttgactcttgttgtgtggctctttgccatcaacgtatatttcaacgccttctggaccattccagtctacaagcccatgcatgacttcctgaaatacgacttcttccagaccatgtcggtgattgggggcttgctcctggtggtggccctgggccctgggggtgtctccatggatgagaagaagaaggagtggtaacagtcacagatccctacctgcctggctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtcctatttttgagtttttttgtgggggtacaggagggggccttcaagctgtactgtgagcagacgcattggtattatcattcaaagcagtctccctcttatttgtaagtttacatttttagcggaaactactaaattattttgggtggttcagccaaacctcaaaacagttaatctccctggtttaaaatcacaccagtggctttgatgttgtttctgccccgcattgtattttataggaatagtgaaaacatttagggacacccaaagaatgatgcagtattaaaggggtggtagaagctgctgtttatgataaaagtcatcggtcagaaaatcagcttggattggtgccaagtgttttattgggtaacaccctgggagttttagtagcttgaggcaaggtggaggggcaagaagtccttggggaagctgctggtctgggtgctgctggcctccaagctggcagtgggaagggctagtgagaccacacaggggtagccccagcagcagcaccctgcaagccagcctggccagctgctcagaccagcttgcagagccgcagccgctgtgggcagggggtgtggcaggagctcccagcactggagacccacggactcaacccagttacctcacatggggccttttctgagcaaggtctcgaaagcgcaggccgccctggctgagcagcaccgccctttcccagctgcactcgccctgtggacagccccgacacaccactttcctgaggctgtcgctcactcagattgtccgtttgctatgccgaatgcagccaaaattcctttttacaatttgtgatgccttaccgatttgatcttaatcctgtatttaaagttttctaacactgccttatactgtgtttctctttttgggggagcttaactgcttgttgctccctgtcgtctgcaccatagtaaatgccacaagggtagtcgaacacctctctggcccctagacctatctggggacaggctggctcagcctgtctccagggctgctgcggcccagccccgagcctgcctccctcttggcctctcatccattggctctgcagggcaggggtgaggcaggtttctgctcataagtgcttttggaagtcacctacctttttaacacagccgaactagtcccaacgcgtttgcaaatattcccctggtagcctacttccttacccccgaatattggtaagatcgagcaatggcttcaggacatgggttctcttctcctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaaggttggttggctgattggtggaaagtagggtggaccaaaggaggccacgtgagcagtcagcaccagttctgcaccagcagcgcctccgtcctagtgggtgttcctgtttctcctggccctgggtgggctagggcctgattcgggaagatgcctttgcagggaggggaggataagtgggatctaccaattgattctggcaaaacaatttctaagatttttttgctttatgtgggaaacagatctaaatctcattttatgctgtattttatatcttagttgtgtttgaaaacgttttgatttttggaaacacatcaaaataaataatggcgtttgttgt

SEQ ID NO: 889 - DNA, 1478 bp, Homo sapiens
ccgagcctcccgccgtcgccatgggccagaacgacctgatgggcacggccgaggacttcgccgaccagttcctccgtgtcacaaagcagtacctgccccacgtggcgcgcctctgtctgatcagcaccttcctggaggacggcatccgtatgtggttccagtggagcgagcagcgcgactacatcgacaccacctggaactgcggctacctgctggcctcgtccttcgtcttcctcaacttgctgggacagctgactggctgcgtcctggtgttgagcaggaacttcgtgcagtacgcctgcttcgggctctttggaatcatagctctgcagacgattgcctacagcattttatgggacttgaagtttttgatgaggaacctggccctgggaggaggcctgttgctgctcctagcagaatcccgttctgaagggaagagcatgtttgcgggcgtccccaccatgcgtgagagctcccccaaacagtacatgcagctcggaggcagggtcttgctggttctgatgttcatgaccctccttcactttgacgccagcttcttttctattgtccagaacatcgtgggcacagctctgatgattttagtggccattggttttaaaaccaagctggctgctttgactcttgttgtgtggctctttgccatcaacgtatatttcaacgccttctggaccattccagtctacaagcccatgcatgacttcctgaaatacgacttcttccagaccatgtcggtgattgggggcttgctcctggtggtggccctgggccctgggggtgtctccatggatgagaagaagaaggagtggtaacagtcacagatccctacctgcctggctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtcctatttttgagtttttttgtgggggtacaggagggggccttcaagctgtactgtgagcagacgcattggtattatcattcaaagcagtctccctcttatttgtaagtttacatttttagcggaaactactaaattattttgggtggttcagccaaacctcaaaacagttaatctccctggtttaaaatcacaccagtggctttgatgttgtttctgccccgcattgtattttataggaatagtgaaaacatttagggacacccaaagaatgatgcagtattaaaggggtggtagaagctgctgtttatgataaaagtcatcggtcagaaaatcaaaaaaaaaaaaaaaaaaaaa

SEQ ID NO: 890 - DNA, 3065 bp, Homo sapiens
gggaggctggggatggcgcgtggcccctttaagacgcaccggggcgggcccgggcggcgcgcggcccctttaaggcttggcctacgtggcagccgctggagccgcagccgacgcggagcgaggccggccgccgggcacttcctgtggaggccgcagcgggtgcgggcgccgacgggcgagagccagcgagcgagcgagcgagccgagccgagcctcccgccgtcgccatgggccagaacgacctgatgggcacggccgaggacttcgccgaccagttcctccgtgtcacaaagcagtacctgccccacgtggcgcgcctctgtctgatcagcaccttcctggaggacggcatccgtatgtggttccagtggagcgagcagcgcgactacatcgacaccacctggaactgcggctacctgctggcctcgtccttcgtcttcctcaacttgctgggacagctgactggctgcgtcctggtgttgagcaggaacttcgtgcagtacgcctgcttcgggctctttggaatcatagctctgcagacgattgcctacagcattttatgggacttgaagtttttgatgaggaacctggccctgggaggaggcctgttgctgctcctagcagaatcccgttctgaagggaagagcatgtttgcgggcgtccccaccatgcgtgagagctcccccaaacagtacatgcagctcggaggcagggtcttgctggttctgatgttcatgaccctccttcactttgacgccagcttcttttctattgtccagaacatcgtgggcacagctctgatgattttagtggccattggttttaaaaccaagctggctgctttgactcttgttgtgtggctctttgccatcaacgtatatttcaacgccttctggaccattccagtctacaagcccatgcatgacttcctgaaatacgacttcttccagaccatgtcggtgattgggggcttgctcctggtggtggccctgggccctgggggtgtctccatggatgagaagaagaaggagtggtaacagtcacagatccctacctgcctggctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtcctatttttgagtttttttgtgggggtacaggagggggccttcaagctgtactgtgagcagacgcattggtattatcattcaaagcagtctccctcttatttgtaagtttacatttttagcggaaactactaaattattttgggtggttcagccaaacctcaaaacagttaatctccctggtttaaaatcacaccagtggctttgatgttgtttctgccccgcattgtattttataggaatagtgaaaacatttagggacacccaaagaatgatgcagtattaaaggggtggtagaagctgctgtttatgataaaagtcatcggtcagaaaatcagcttggattggtgccaagtgttttattgggtaacaccctgggagttttagtagcttgaggcaaggtggaggggcaagaagtccttggggaagctgctggtctgggtgctgctggcctccaagctggcagtgggaagggctagtgagaccacacaggggtagccccagcagcagcaccctgcaagccagcctggccagctgctcagaccagcttgcagagccgcagccgctgtgggcagggggtgtggcaggagctcccagcactggagacccacggactcaacccagttacctcacatggggccttttctgagcaaggtctcgaaagcgcaggccgccctggctgagcagcaccgccctttcccagctgcactcgccctgtggacagccccgacacaccactttcctgaggctgtcgctcactcagattgtccgtttgctatgccgaatgcagccaaaattcctttttacaatttgtgatgccttaccgatttgatcttaatcctgtatttaaagttttctaacactgccttatactgtgtttctctttttgggggagcttaactgcttgttgctccctgtcgtctgcaccatagtaaatgccacaagggtagtcgaacacctctctggcccctagacctatctggggacaggctggctcagcctgtctccagggctgctgcggcccagccccgagcctgcctccctcttggcctctcatccattggctctgcagggcaggggtgaggcaggtttctgctcataagtgcttttggaagtcacctacctttttaacacagccgaactagtcccaacgcgtttgcaaatattcccctggtagcctacttccttacccccgaatattggtaagatcgagcaatggcttcaggacatgggttctcttctcctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaaggttggttggctgattggtggaaagtagggtggaccaaaggaggccacgtgagcagtcagcaccagttctgcaccagcagcgcctccgtcctagtgggtgttcctgtttctcctggccctgggtgggctagggcctgattcgggaagatgcctttgcagggaggggaggataagtgggatctaccaattgattctggcaaaacaatttctaagatttttttgctttatgtgggaaacagatctaaatctcattttatgctgtattttatatcttagttgtgtttgaaaacgttttgatttttggaaacacatcaaaataaataatggcgtttgttgt

SEQ ID NO: 891 - DNA, 3046 bp, Homo sapiens
gcgtctccctccccgtttggactctgccctgggctggattgagtggggacctgtacacagcctgggaggaggggaagcctatctccctgatagtctccttccagaagtgtccaggtggcattctgagcaacagggaagcctttgaaacaggcggttggcgtctgttcctcacacaccccgcccaaggacgtgcctggcagcggcctggtgctccccgccgcagccacctcacccttgggtttctgtggccctgcagttcctccgtgtcacaaagcagtacctgccccacgtggcgcgcctctgtctgatcagcaccttcctggaggacggcatccgtatgtggttccagtggagcgagcagcgcgactacatcgacaccacctggaactgcggctacctgctggcctcgtccttcgtcttcctcaacttgctgggacagctgactggctgcgtcctggtgttgagcaggaacttcgtgcagtacgcctgcttcgggctctttggaatcatagctctgcagacgattgcctacagcattttatgggacttgaagtttttgatgaggaacctggccctgggaggaggcctgttgctgctcctagcagaatcccgttctgaagggaagagcatgtttgcgggcgtccccaccatgcgtgagagctcccccaaacagtacatgcagctcggaggcagggtcttgctggttctgatgttcatgaccctccttcactttgacgccagcttcttttctattgtccagaacatcgtgggcacagctctgatgattttagtggccattggttttaaaaccaagctggctgctttgactcttgttgtgtggctctttgccatcaacgtatatttcaacgccttctggaccattccagtctacaagcccatgcatgacttcctgaaatacgacttcttccagaccatgtcggtgattgggggcttgctcctggtggtggccctgggccctgggggtgtctccatggatgagaagaagaaggagtggtaacagtcacagatccctacctgcctggctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtcctatttttgagtttttttgtgggggtacaggagggggccttcaagctgtactgtgagcagacgcattggtattatcattcaaagcagtctccctcttatttgtaagtttacatttttagcggaaactactaaattattttgggtggttcagccaaacctcaaaacagttaatctccctggtttaaaatcacaccagtggctttgatgttgtttctgccccgcattgtattttataggaatagtgaaaacatttagggacacccaaagaatgatgcagtattaaaggggtggtagaagctgctgtttatgataaaagtcatcggtcagaaaatcagcttggattggtgccaagtgttttattgggtaacaccctgggagttttagtagcttgaggcaaggtggaggggcaagaagtccttggggaagctgctggtctgggtgctgctggcctccaagctggcagtgggaagggctagtgagaccacacaggggtagccccagcagcagcaccctgcaagccagcctggccagctgctcagaccagcttgcagagccgcagccgctgtgggcagggggtgtggcaggagctcccagcactggagacccacggactcaacccagttacctcacatggggccttttctgagcaaggtctcgaaagcgcaggccgccctggctgagcagcaccgccctttcccagctgcactcgccctgtggacagccccgacacaccactttcctgaggctgtcgctcactcagattgtccgtttgctatgccgaatgcagccaaaattcctttttacaatttgtgatgccttaccgatttgatcttaatcctgtatttaaagttttctaacactgccttatactgtgtttctctttttgggggagcttaactgcttgttgctccctgtcgtctgcaccatagtaaatgccacaagggtagtcgaacacctctctggcccctagacctatctggggacaggctggctcagcctgtctccagggctgctgcggcccagccccgagcctgcctccctcttggcctctcatccattggctctgcagggcaggggtgaggcaggtttctgctcataagtgcttttggaagtcacctacctttttaacacagccgaactagtcccaacgcgtttgcaaatattcccctggtagcctacttccttacccccgaatattggtaagatcgagcaatggcttcaggacatgggttctcttctcctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaaggttggttggctgattggtggaaagtagggtggaccaaaggaggccacgtgagcagtcagcaccagttctgcaccagcagcgcctccgtcctagtgggtgttcctgtttctcctggccctgggtgggctagggcctgattcgggaagatgcctttgcagggaggggaggataagtgggatctaccaattgattctggcaaaacaatttctaagatttttttgctttatgtgggaaacagatctaaatctcattttatgctgtattttatatcttagttgtgtttgaaaacgttttgatttttggaaacacatcaaaataaataatggcgtttgttgt

SEQ ID NO: 892 - DNA, 1970 bp, Homo sapiens
gcaggtggggagcttggcccgcggtcgtggttcccgccgtcctgtgcctttaaggctctcgccgctcaccagcatttggggctcctgctgtgtcggcccccagctgacttggctttaggggtcggcgtggagggttaaagaggccccggctgggtttgcggagcagccaagcctggcaaaatcgaaagggagggctcaaagagactgtatccttaacccccaaaaagctggtctaaaaggatgggaggccagaccgctgaccgttccccactctcgacagagtccagccgtgtggagcacacgatgctgcaaacttgcatgtcatctctttcaggtgtggcatttcaagggggcttgtgtcttgaaaacagcaactgtgaggacacttgatagtcatttccttcagttctgcttttgtctccctaggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaaggtacagagactccatcagttcttcaaaaacacaccacagaaaatgtttcagctacaagaaccccaccaactcctcagaaacccaccacagtaaatgtcccagctacaatagtcacaccaacacctcagaaacccaccacaataaatgttccagctacaggagtctcatcaacacctcaaagacacaccatagtaaatgtttcagctacaggaaccctaccaactcttcagaaacccaccagagcaaatgattcagccaccaaatccccagcagcagctcagacatctttcatatcaaaaaccctatctacaaagaccccttctgcagctcagaatcccatgatgacaaatgcttctgctacacaggccacactaacagcccaaaaattcaccacagcaaaagttgcatttacgcagagtccttcagcagcacgtaagtccactaatgtacattccccagtgactaatggtctcaagagtacacaaagattcccttctgctcatattacagcaacacggagtacacctgtttccaggacaaccaagcattttcatgaaacaaccccaaataaaggaagtggaaccacttcaggtactacccgtcttctatctgctcttataatgcacatgagagcaacaaagtactcaatgttgtgtttgaccatt

SEQ ID NO: 893 - DNA, 1846 bp, Homo sapiens
tatgacgccggagccctctgaccgcacctctgaccacaacaaacccctactccacccgtcttgtttgtcccacccttggtgacgcagagccccagcccagaccccgcccaaagcactcatttaactggtattgcggagccacgaggcttctgcttactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatatttta

SEQ ID NO: 894 - DNA, 2640 bp, Homo sapiens
tatgacgccggagccctctgaccgcacctctgaccacaacaaacccctactccacccgtcttgtttgtcccacccttggtgacgcagagccccagcccagaccccgcccaaagcactcatttaactggtattgcggagccacgaggcttctgcttactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtaagaaagcatagagatttgttcgtatttagaatgggatcacgaggaaaagagaaggaaagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatattttaaaggtaaaacatgctggtgaaccaggggtgttgatggtgataagggaggaatatagaatgaaagactgaatcttcctttgttgcacaaatagagtttggaaaaagcctgtgaaaggtgtcttctttgacttaatgtctttaaaagtatccagagatactacaatattaacataagaaaagattatatattatttctgaatcgagatgtccatagtcaaatttgtaaatcttattcttttgtaatatttatttatatttatttatgacagtgaacattctgattttacatgtaaaacaagaaaagttgaagaagatatgtgaagaaaaatgtatttttcctaaatagaaataaatgatcccattttttggtatcatgtagtatgtgaaatttattcttaaacgtgactactttatttctaaataagaaattccctacctgcttcctacaagcagttcagaatgccatgccttggttgtcctagtgtgaataattttcagctactttaaaattatattgtactttctcaagcatgtcatatcctttcctattagagtatctatattacttgttactgatttacctgaaggcaatctgattaatttctaggtttttaccatattcttgtcatcttgccaattacattttaagtgttagactagactaagatgtactagttgtatagaatataactagatttattatggcaatgtttattttgtcattttgcttcatctg

SEQ ID NO: 895 - DNA, 1809 bp, Homo sapiens
gcaggtggggagcttggcccgcggtcgtggttcccgccgtcctgtgcctttaaggctctcgccgctcaccagcatttggggctcctgctgtgtcggcccccagctgacttggctttaggggtcggcgtggagggttaaagaggccccggctgggtttgcggagcagccaagcctggcaaaatcgaaagggagggctcaaagagactgtatccttaacccccaaaaagctggtctaaaaggatgggaggccagaccgctgaccgttccccactctcgacagagtccagccgtgtggagcacacgatgctgcaaacttgcatgtcatctctttcaggtgtggcatttcaagggggcttgtgtcttgaaaacagcaactgtgaggacacttgatagtcatttccttcagttctgcttttgtctccctaggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatatttta

SEQ ID NO: 896 - DNA, 1964 bp, Homo sapiens
tatgacgccggagccctctgaccgcacctctgaccacaacaaacccctactccacccgtcttgtttgtcccacccttggtgacgcagagccccagcccagaccccgcccaaagcactcatttaactggtattgcggagccacgaggcttctgcttactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctggttctcgtcctgtcacccaggctggtatgcggtggtgtgatcgtagctcactgcagtctcgaactcctgggttcaagcgatccttccacttcagcctcccaagtagctggtactacagggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatatttta

SEQ ID NO: 897 - DNA, 2367 bp, Homo sapiens
gcaggtggggagcttggcccgcggtcgtggttcccgccgtcctgtgcctttaaggctctcgccgctcaccagcatttggggctcctgctgtgtcggcccccagctgacttggctttaggggtcggcgtggagggttaaagaggccccggctgggtttgcggagcagccaagcctggcaaaatcgaaagggagggctcaaagagactgtatccttaacccccaaaaagctggtctaaaaggatgggaggccagaccgctgaccgttccccactctcgacagagtccagccgtgtggagcacacgatgctgcaaacttgcatgtcatctctttcaggtgtggcatttcaagggggcttgtgtcttgaaaacagcaactgtgaggacacttgatagtcatttccttcagttctgcttttgtctccctaggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaaggtacagagactccatcagttcttcaaaaacacaccacagaaaatgtttcagctacaagaaccccaccaactcctcagaaacccaccacagtaaatgtcccagctacaatagtcacaccaacacctcagaaacccaccacaataaatgttccagctacaggagtctcatcaacacctcaaagacacaccatagtaaatgtttcagctacaggaaccctaccaactcttcagaaacccaccagagcaaatgattcagccaccaaatccccagcagcagctcagacatctttcatatcaaaaaccctatctacaaagaccccttctgcagctcagaatcccatgatgacaaatgcttctgctacacaggccacactaacagcccaaaaattcaccacagcaaaagttgcatttacgcagagtccttcagcagcaccaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatatttta

SEQ ID NO: 898 - DNA, 1526 bp, Homo sapiens
tatgacgccggagccctctgaccgcacctctgaccacaacaaacccctactccacccgtcttgtttgtcccacccttggtgacgcagagccccagcccagaccccgcccaaagcactcatttaactggtattgcggagccacgaggcttctgcttactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtaagtttgggcatactaaaaccctgtatttaggaaatgagaaaacaaattaggacttaaggtgagattgttagtttcatgactggtattcacagctagtagcaattaaaacaatccctctcctcaaagacccttcatcatgagctcatcacagttaaatttagtaaaatgggggcaagaaaggaagatttcttaaaccaccagaattctctaaattctgatttcagtaaatatgtgattcaatataaaattttaaatgtgattaataaaaaaatttgagatgatgatacttgcagaaatcttcaaatgttaaatactaaaccaatctttagttgacctaaataatgaatttgcatgagtttttctatatgcaaacaagctgttacaaaacagcatgagttaaagacattcctagtgtgaaagtattctaagttctttgataagttctctgtatagggagaaggaactcattcattgagtaccatcaatgtctcagacactgttgaaaactttacatttattttctcatttcatatctgtaaattaaataattctattttactctgtgtgtgtccctattctttataaagtaaaaatatcagtatcacttgtctcctatacgaaacacagatattggttaggtcatgaacacaaaatctgggaagtactttgaaccctttaaatataagtacattctattattctgtgaag

SEQ ID NO: 899 - DNA, 1935 bp, Homo sapiens
gcaggtggggagcttggcccgcggtcgtggttcccgccgtcctgtgcctttaaggctctcgccgctcaccagcatttggggctcctgctgtgtcggcccccagctgacttggctttaggggtcggcgtggagggttaaagaggccccggctgggtttgcggagcagccaagcctggcaaaatcgaaagggagggctcaaagagactgtatccttaacccccaaaaagctggtctaaaaggatgggaggccagaccgctgaccgttccccactctcgacagagtccagccgtgtggagcacacgatgctgcaaacttgcatgtcatctctttcaggtgtggcatttcaagggggcttgtgtcttgaaaacagcaactgtgaggacacttgatagtcatttccttcagttctgcttttgtctccctaggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatatttta

SEQ ID NO: 900 - DNA, 1636 bp, Homo sapiens
gcaggtggggagcttggcccgcggtcgtggttcccgccgtcctgtgcctttaaggctctcgccgctcaccagcatttggggctcctgctgtgtcggcccccagctgacttggctttaggggtcggcgtggagggttaaagaggccccggctgggtttgcggagcagccaagcctggcaaaatcgaaagggagggctcaaagagactgtatccttaacccccaaaaagctggtctaaaaggatgggaggccagaccgctgaccgttccccactctcgacagagtccagccgtgtggagcacacgatgctgcaaacttgcatgtcatctctttcaggtgtggcatttcaagggggcttgtgtcttgaaaacagcaactgtgaggacacttgatagtcatttccttcagttctgcttttgtctccctaggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtcagttgacactgttcaggtttactgagtatggatctaatgtgctatggtggaaatatgaacttgaccaagattgcaggattaaatggtctctaatttattgtagccagggtttttcatactaatactttttactttatttggaagcggacttggattgtactagggcaaatctttaaaaaaagaaacatttacaataatagagaaaaagactgtggccccattaaaaaaatgctaaattaagattggt

SEQ ID NO: 901 - DNA, 2445 bp, Homo sapiens
gcaggtggggagcttggcccgcggtcgtggttcccgccgtcctgtgcctttaaggctctcgccgctcaccagcatttggggctcctgctgtgtcggcccccagctgacttggctttaggggtcggcgtggagggttaaagaggccccggctgggtttgcggagcagccaagcctggcaaaatcgaaagggagggctcaaagagactgtatccttaacccccaaaaagctggtctaaaaggatgggaggccagaccgctgaccgttccccactctcgacagagtccagccgtgtggagcacacgatgctgcaaacttgcatgtcatctctttcaggtgtggcatttcaagggggcttgtgtcttgaaaacagcaactgtgaggacacttgatagtcatttccttcagttctgcttttgtctccctaggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaaggtacagagactccatcagttcttcaaaaacacaccacagaaaatgtttcagctacaagaaccccaccaactcctcagaaacccaccacagtaaatgtcccagctacaatagtcacaccaacacctcagaaacccaccacaataaatgttccagctacaggagtctcatcaacacctcaaagacacaccatagtaaatgtttcagctacaggaaccctaccaactcttcagaaacccaccagagcaaatgattcagccaccaaatccccagcagcagctcagacatctttcatatcaaaaaccctatctacaaagaccccttctgcagctcagaatcccatgatgacaaatgcttctgctacacaggccacactaacagcccaaaaattcaccacagcaaaagttgcatttacgcagagtccttcagcagcacgtaagtccactaatgtacattccccagtgactaatggtctcaagagtacacaaagattcccttctgctcatattacagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatatttta

SEQ ID NO: 902 - DNA, 2768 bp, Homo sapiens
gccacgtgtccggctcggagcccacggctgtcctcccggtccgccccgcgctgcggttgctgctgggctaacgggctccgatccagcgagcgctgcgtcctcgagtccctgcgcccgtgcgtccgtctgcgacccgaggcctccgctgcgcgtggattctgctgcgaaccggagaccatggccaaaccagcacagggtgccaagtaccggggctccatccatgacttcccaggctttgaccccaaccaggatgccgaggctctgtacactgccatgaagggctttggcagtgacaaggaggccatactggacataatcacctcacggagcaacaggcagaggcaggaggtctgccagagctacaagtccctctacggcaaggacctcattgctgatttaaagtatgaattgacgggcaagtttgaacggttgattgtgggcctgatgaggccacctgcctattgtgatgccaaagaaattaaagatgccatctcgggcattggcactgatgagaagtgcctcattgagatcttggcttcccggaccaatgagcagatgcaccagctggtggcagcatacaaagatgcctacgagcgggacctggaggctgacatcatcggcgacacctctggccacttccagaagatgcttgtggtcctgctccagggaaccagggaggaggatgacgtagtgagcgaggacctggtacaacaggatgtccaggacctatacgaggcaggggaactgaaatggggaacagatgaagcccagttcatttacatcttgggaaatcgcagcaagcagcatcttcggttggtgttcgatgagtatctgaagaccacagggaagccgattgaagccagcatccgaggggagctgtctggggactttgagaagctaatgctggccgtagtgaagtgtatccggagcaccccggaatattttgctgaaaggctcttcaaggctatgaagggcctggggactcgggacaacaccctgatccgcatcatggtctcccgtagtgagttggacatgctcgacattcgggagatcttccggaccaagtatgagaagtccctctacagcatgatcaagaatgacacctctggcgagtacaagaagactctgctgaagctgtctgggggagatgatgatgctgctggccagttcttcccggaggcagcgcaggtggcctatcagatgtgggaacttagtgcagtggcccgagtagagctgaagggaactgtgcgcccagccaatgacttcaaccctgacgcagatgccaaagcgctgcggaaagccatgaagggactcgggactgacgaagacacaatcatcgatatcatcacgcaccgcagcaatgtccagcggcagcagatccggcagaccttcaagtctcactttggccgggacttaatgactgacctgaagtctgagatctctggagacctggcaaggctgattctggggctcatgatgccaccggcccattacgatgccaagcagttgaagaaggccatggagggagccggcacagatgaaaaggctcttattgaaatcctggccactcggaccaatgctgaaatccgggccatcaatgaggcctataaggaggactatcacaagtccctggaggatgctctgagctcagacacatctggccacttcaggaggatcctcatttctctggccacggggcatcgtgaggagggaggagaaaacctggaccaggcacgggaagatgcccaggtggctgctgagatcttggaaatagcagacacacccagtggagacaaaacttccttggagacacgtttcatgacgatcctgtgtacccggagctatccgcacctccggagagtcttccaggagttcatcaagatgaccaactatgacgtggagcacaccatcaagaaggagatgtctggggatgtcagggatgcatttgtggccattgttcaaagtgtcaagaacaagcctctcttctttgccgacaaactttacaaatccatgaagggtgctggcacagatgagaagactctgaccaggatcatggtatcccgcagtgagattgacctgctcaacatccggagggaattcattgagaaatatgacaagtctctccaccaagccattgagggtgacacctccggagacttcctgaaggccttgctggctctctgtggtggtgaggactagggccacagctttggcgggcacttctgccaagaaatggttatcagcaccagccgccatggccaagcctgattgttccagctccagagactaaggaaggggcaggggtggggggaggggttgggttgggctcttatcttcagtggagcttaggaaacgctcccactcccacgggccatcgagggcccagcacggctgagcggctgaaaaaccgtagccatagatcctgtccacctccactcccctctgaccctcaggctttcccagcttcctccccttgctacagcctctgccctggtttgggctatgtcagatccaaaaacatcctgaacctctgtctgtaaaatgagtagtgtctgtactttgaatgagggggttggtggcaggggccagttgaatgtgctgggcggggtggtgggaaggatagtaaatgtgctggggcaaactgacaaatcttcccatccatttcaccacccatctccatccaggccgcgctagagtactggaccaggaatttggatgcctgggttcaaatctgcatctgccatgcacttgtttctgaccttaggcca

SEQ ID NO: 903 - DNA, 2750 bp, Homo sapiens
gccacgtgtccggctcggagcccacggctgtcctcccggtccgccccgcgctgcggttgctgctgggctaacgggctccgatccagcgagcgctgcgtcctcgagtccctgcgcccgtgcgtccgtctgcgacccgaggcctccgctgcgcgtggattctgctgcgaaccggagaccatggccaaaccagcacagggtgccaagtaccggggctccatccatgacttcccaggctttgaccccaaccaggatgccgaggctctgtacactgccatgaagggctttggcagtgacaaggaggccatactggacataatcacctcacggagcaacaggcagaggcaggaggtctgccagagctacaagtccctctacggcaaggacctcattgctgatttaaagtatgaattgacgggcaagtttgaacggttgattgtgggcctgatgaggccacctgcctattgtgatgccaaagaaattaaagatgccatctcgggcattggcactgatgagaagtgcctcattgagatcttggcttcccggaccaatgagcagatgcaccagctggtggcagcatacaaagatgcctacgagcgggacctggaggctgacatcatcggcgacacctctggccacttccagaagatgcttgtggtcctgctccagggaaccagggaggaggatgacgtagtgagcgaggacctggtacaacaggatgtccaggacctatacgaggcaggggaactgaaatggggaacagatgaagcccagttcatttacatcttgggaaatcgcagcaagcagcatcttcggttggtgttcgatgagtatctgaagaccacagggaagccgattgaagccagcatccgaggggagctgtctggggactttgagaagctaatgctggccgtagtgaagtgtatccggagcaccccggaatattttgctgaaaggctcttcaaggctatgaagggcctggggactcgggacaacaccctgatccgcatcatggtctcccgtagtgagttggacatgctcgacattcgggagatcttccggaccaagtatgagaagtccctctacagcatgatcaagaatgacacctctggcgagtacaagaagactctgctgaagctgtctgggggagatgatgatgctgctggccagttcttcccggaggcagcgcaggtggcctatcagatgtgggaacttagtgcagtggcccgagtagagctgaagggaactgtgcgcccagccaatgacttcaaccctgacgcagatgccaaagcgctgcggaaagccatgaagggactcgggactgacgaagacacaatcatcgatatcatcacgcaccgcagcaatgtccagcggcagcagatccggcagaccttcaagtctcactttggccgggacttaatgactgacctgaagtctgagatctctggagacctggcaaggctgattctggggctcatgatgccaccggcccattacgatgccaagcagttgaagaaggccatggagggagccggcacagatgaaaaggctcttattgaaatcctggccactcggaccaatgctgaaatccgggccatcaatgaggcctataaggaggactatcacaagtccctggaggatgctctgagctcagacacatctggccacttcaggaggatcctcatttctctggccacggggcatcgtgaggagggaggagaaaacctggaccaggcacgggaagatgcccaggaaatagcagacacacccagtggagacaaaacttccttggagacacgtttcatgacgatcctgtgtacccggagctatccgcacctccggagagtcttccaggagttcatcaagatgaccaactatgacgtggagcacaccatcaagaaggagatgtctggggatgtcagggatgcatttgtggccattgttcaaagtgtcaagaacaagcctctcttctttgccgacaaactttacaaatccatgaagggtgctggcacagatgagaagactctgaccaggatcatggtatcccgcagtgagattgacctgctcaacatccggagggaattcattgagaaatatgacaagtctctccaccaagccattgagggtgacacctccggagacttcctgaaggccttgctggctctctgtggtggtgaggactagggccacagctttggcgggcacttctgccaagaaatggttatcagcaccagccgccatggccaagcctgattgttccagctccagagactaaggaaggggcaggggtggggggaggggttgggttgggctcttatcttcagtggagcttaggaaacgctcccactcccacgggccatcgagggcccagcacggctgagcggctgaaaaaccgtagccatagatcctgtccacctccactcccctctgaccctcaggctttcccagcttcctccccttgctacagcctctgccctggtttgggctatgtcagatccaaaaacatcctgaacctctgtctgtaaaatgagtagtgtctgtactttgaatgagggggttggtggcaggggccagttgaatgtgctgggcggggtggtgggaaggatagtaaatgtgctggggcaaactgacaaatcttcccatccatttcaccacccatctccatccaggccgcgctagagtactggaccaggaatttggatgcctgggttcaaatctgcatctgccatgcacttgtttctgaccttaggcca

SEQ ID NO: 904 - DNA, 2510 bp, Homo sapiens
gccacgtgtccggctcggagcccacggctgtcctcccggtccgcgccgctgcggttgctgctgggctaacgggctccgatccagcgagcgctgcgtcctcgagtccgcccgtgcgggcgcagggacccgaggcctccgctgcggctggattctgctgcgaaccggagaccatggccaaaccagcacagggtgccaagtaccggggctccatccatgacttcccaggctttgaccccaaccaggatgccgaggctctgtacactgccatgaagggctttggcagtgacaaggaggccatactggacataatcacctcacggagcaacaggcagaggcaggaggtctgccagagctacaagtccctctacggcaaggacctcattgctgatttaaagtatgaattgacgggcaagtttgaacggttgattgtgggcctgatgaggccacctgcctattgtgatgccaaagaaattaaagatgccatctcgggcattggcactgatgagaagtgcctcattgagatcttggcttcccggaccaatgagcagatgcaccagctggtggcagcatacaaagatgcctacgagcgggacctggaggctgacatcatcggcgacacctctggccacttccagaagatgcttgtggtcctgctccagggaaccagggaggaggatgacgtagtgagcgaggacctggtacaacaggatgtccaggacctatacgaggcaggggaactgaaatggggaacagatgaagcccagttcatttacatcttgggaaatcgcagcaagcagcatcttcggttggtgttcgatgagtatctgaagaccacagggaagccgatgaaggccagcatccgaggggagctgtctggggactttgagaagctaatgctggccgtagtgaagtgtatccggagcaccccggaatattttgctgaaaggctcttcaaggctatgaagggcctggggactcgggacaacaccctgatccgcatcatggtctcccgtagtgagttggacatgctcgacattcgggagatcttccggaccaagtatgagaagtccctctacagcatgatcaagaatgacacctctggcgagtacaagaagactctgctgaagctgtctgggggagatgatgatgctgctggccagttcttcccggaggcagcgcaggtggcctatcagatgtgggaacttagtgcagtggcccgagtagagctgaagggaactgtgcgcccagccaatgacttcaaccctgacgcagatgccaaagcgctgcggaaagccatgaagggactcgggactgacgaagacacaatcatcgatatcatcacgcaccgcagcaatgtccagcggcagcagatccggcagaccttcaagtctcactttggccgggacttaatgactgacctgaagtctgagatctctggagacctggcaaggctgattctggggctcatgatgccaccggcccattacgatgccaagcagttgaagaaggccatggagggagccggcacagatgaaaaggctcttattgaaatcctggccactcggaccaatgctgaaatccgggccatcaatgaggcctataaggaggactatcacaagtccctggaggatgctctgagctcagacacatctggccacttcaggaggatcctcatttctctggccacggggcatcgtgaggagggaggagaaaacctggaccaggcacgggaagatgcccaggaaatagcagacacacctagtggagacaaaacttccttggagacacgtttcatgacgatcctgtgtacccggacgtatccgcacctccggagagtcttccaggagttcatcaagatgaccaactatgacgtggagcacaccatcaagaaggagatgtctggggatgtcagggatgcatttgtggccattgttcaaagtgtcaagaacaagcctctcttctttgccgacaaactttacaaatccatgaagggtgctggcacagatgagaagactctgaccaggatcatggtatcccgcagtgagattgacctgctcaacatccggagggaattcattgagaaatatgacaagtctctccaccaagccattgagggtgacacctccggagacttcctgaaggccttgctggctctctgtggtggtgaggactagggccacagctttggcgggcacttctgccaagaaatggttatcagcaccagccgccatggccaagcctgattgttccagctccagagactaaggaaggggcaggggtggggggaggggttgggttgggctcttatcttcatggagcttaggaaacgctcccactcccacgggccatcgagggccagcacggctgagcggtgaaaaaccgtagccatagatcctgtccacctccactcccctctgaccctcaggctttcccagcttcctccccttgctacagcctctgccctggtttggctatgtcagatccaataaacatcctgaacctctgtctgt

SEQ ID NO: 905 - DNA, 2735 bp, Homo sapiens
gccacgtgtccggctcggagcccacggctgtcctcccggtccgccccgcgctgcggttgctgctgggctaacgggctccgatccagcgagcgctgcgtcctcgagtccctgcgcccgtgcgtccgtctgcgacccgaggcctccgctgcgcgtggattctgctgcgaaccggagaccatggccaaaccagcacagggtgccaagtaccggggctccatccatgacttcccaggctttgaccccaaccaggatgccgaggctctgtacactgccatgaagggctttggcagtgacaaggaggccatactggacataatcacctcacggagcaacaggcagaggcaggaggtctgccagagctacaagtccctctacggcaaggacctcattgctgatttaaagtatgaattgacgggcaagtttgaacggttgattgtgggcctgatgaggccacctgcctattgtgatgccaaagaaattaaagatgccatctcgggcattggcactgatgagaagtgcctcattgagatcttggcttcccggaccaatgagcagatgcaccagctggtggcagcatacaaagatgcctacgagcgggacctggaggctgacatcatcggcgacacctctggccacttccagaagatgcttgtggtcctgctccagggaaccagggaggaggatgacgtagtgagcgaggacctggtacaacaggatgtccaggacctatacgaggcaggggaactgaaatggggaacagatgaagcccagttcatttacatcttgggaaatcgcagcaagcagcatcttcggttggtgttcgatgagtatctgaagaccacagggaagccgattgaagccagcatccgaggggagctgtctggggactttgagaagctaatgctggccgtagtgaagtgtatccggagcaccccggaatattttgctgaaaggctcttcaaggctatgaagggcctggggactcgggacaacaccctgatccgcatcatggtctcccgtagtgagttggacatgctcgacattcgggagatcttccggaccaagtatgagaagtccctctacagcatgatcaagaatgacacctctggcgagtacaagaagactctgctgaagctgtctgggggagatgatgatgctgctggccagttcttcccggaggcagcgcaggtggcctatcagatgtgggaacttagtgcagtggcccgagtagagctgaagggaactgtgcgcccagccaatgacttcaaccctgacgcagatgccaaagcgctgcggaaagccatgaagggactcgggactgacgaagacacaatcatcgatatcatcacgcaccgcagcaatgtccagcggcagcagatccggcagaccttcaagtctcactttggccgggacttaatgactgacctgaagtctgagatctctggagacctggcaaggctgattctggggctcatgatgccaccggcccattacgatgccaagcagttgaagaaggccatggagggagccggcacagatgaaaaggctcttattgaaatcctggccactcggaccaatgctgaaatccgggccatcaatgaggcctataaggaggactatcacaagtccctggaggatgctctgagctcagacacatctggccacttcaggaggatcctcatttctctggccacggggcatcgtgaggagggaggagaaaacctggaccaggcacgggaagatgcccaggtggctgctgagatcttggaaatagcagacacacccagtggagacaaaacttccttggagacacgtttcatgacgatcctgtgtacccggagctatccgcacctccggagagtcttccaggagttcatcaagatgaccaactatgacgtggagcacaccatcaagaaggagatgtctggggatgtcagggatgcatttgtggccattgttcaaagtgtcaagaacaagcctctcttctttgccgacaaactttacaaatccatgaagggtgctggcacagatgagaagactctgaccaggatcatggtatcccgcagtgagattgacctgctcaacatccggagggaattcattgagaaatatgacaagtctctccaccaagccattgagggtgacacctccggagacttcctgaaggccttgctggctctctgtggtggtgaggactagggccacagctttggcgggcacttctgccaagcctgattgttccagctccagagactaaggaaggggcaggggtggggggaggggttgggttgggctcttatcttcagtggagcttaggaaacgctcccactcccacgggccatcgagggcccagcacggctgagcggctgaaaaaccgtagccatagatcctgtccacctccactcccctctgaccctcaggctttcccagcttcctccccttgctacagcctctgccctggtttgggctatgtcagatccaaaaacatcctgaacctctgtctgtaaaatgagtagtgtctgtactttgaatgagggggttggtggcaggggccagttgaatgtgctgggcggggtggtgggaaggatagtaaatgtgctggggcaaactgacaaatcttcccatccatttcaccacccatctccatccaggccgcgctagagtactggaccaggaatttggatgcctgggttcaaatctgcatctgccatgcacttgtttctgaccttaggcca

SEQ ID NO: 906 - DNA, 2361 bp, Homo sapiens
atggccaaaccagcacagggtgccaagtaccggggctccatccatgacttcccaggctttgaccccaaccaggatgccgaggctctgtacactgccatgaagggctttggcagtgacaaggaggccatattggacataatcacctcacggagcaacaggcagaggcaggaggtctgccagagctacaagtccctctacggcaaggacctcattgctgatttaaagtatgaattgacgggcaagtttgaacggttgattgtgggcctgatgaggccacctgcctattgtgatgccaaagaaattaaagatgccatctcgggcattggcactgatgagaagtgcctcattgagatcttggcttcccggaccaatgagcagatgcaccagctggtggcagcatacaaagatgcctacgagcgggacctggaggctgacatcatcggcgacacctctggccacttccagaagatgcttgtggtcctgctccagggaaccagggaggaggatgacgtagtgagcgaggacctggtacaacaggatgtccaggacctatacgaggcaggggaactgaaatggggaacagatgaagcccagttcatttacatcttgggaaatcgcagcaagcagcatcttcggttggtgttcgatgagtatctgaagaccacagggaagccgattgaagccagcatccgaggggagctgtctggggactttgagaagctaatgctggccgtagtgaagtgtatccggagcaccccggaatattttgctgaaaggctcttcaaggctatgaagggcctggggactcgggacaacaccctgatccgcatcatggtctcccgtagtgagttggacatgctcgacattcgggagatcttccggaccaagtatgagaagtccctctacagcatgatcaagaatgacacctctggcgagtacaagaagactctgctgaagctgtctgggggagatgatgatgctgctggccagttcttcccggaggcagcgcaggtggcctatcagatgtgggaacttagtgcagtggcccgagtagagctgaagggaactgtgcgcccagccaatgacttcaaccctgacgcagatgccaaagcgctgcggaaagccatgaagggactcgggactgacgaagacacaatcatcgatatcatcacgcaccgcagcaatgtccagcggcagcagatccggcagaccttcaagtctcactttggccgggacttaatgactgacctgaagtctgagatctctggagacctggcaaggctgattctggggctcatgatgccaccggcccattacgatgccaagcagttgaagaaggccatggagggagccggcacagatgaaaaggctcttattgaaatcctggccactcggaccaatgctgaaatccgggccatcaatgaggcctataaggaggactatcacaagtccctggaggatgctctgagctcagacacatctggccacttcaggaggatcctcatttctctggccacggggcatcgtgaggagggaggagaaaacctggaccaggcacgggaagatgcccaggtggctgctgagatcttggaaatagcagacacacccagtggagacaaaacttccttggagacacgtttcatgacgatcctgtgtacccggagctatccgcacctccggagagtcttccaggagttcatcaagatgaccaactatgacgtggagcacaccatcaagaaggagatgtctggggatgtcagggatgcatttgtggccattgttcaaagtgtcaagaacaagcctctcttctttgccgacaaactttacaaatccatgaagggtgctggcacagatgagaagactctgaccaggatcatggtatcccgcagtgagattgacctgctcaacatccggagggaattcattgagaaatatgacaagtctctccaccaagccattgagggtgacacctccggagacttcctgaaggccttgctggctctctgtggtggtgaggactagggccacagctttggcgggcacttctgccaagaaatggttatcagcaccagccgccatggccaagcctgattgttccagctccagagactaaggaaggggcaggggtggggggaggggttgggttgggctcttatcttcagtggagcttaggaaacgctcccactcccacgggccatcgagggcccagcacggctgagcggctgaaaaaccgtagccatagatcctgtccacctccactcccctctgaccctcaggctttcccagcttcctccccttgctacagcctctgccctggtttgggctatgtcagatccaaaaacatcctgaacctctgtctgt

SEQ ID NO: 907 - DNA, 4682 bp, Homo sapiens
agggccgggcttcgtgcggtggggctcgctcgcgcggcagcggtggccgaggcctcttggttctgcggcacgtgacggtcgggccgcctccgcctctctctttactgcggcgcggggcaaggtgtgcgggcgggaaggggcacgggcacccccgcggtccccgggaggctagagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaactctgtcagggtggattttatccaaagccaagaaagacgataccgatgatgaaattgccaaatatgatggaaagtgggaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtatgaggttaatttccaaaatggaatagaatgtggtggtgcctatgtgaaactgctttctaaaacaccagaactcaacctggatcagttccatgacaagaccccttatacgattatgtttggtccagataaatgtggagaggactataaactgcacttcatcttccgacacaaaaaccccaaaacgggtatctatgaagaaaaacatgctaagaggccagatgcagatctgaagacctattttactgataagaaaacacatctttacacactaatcttgaatccagataatagttttgaaatactggttgaccaatctgtggtgaatagtggaaatctgctcaatgacatgactcctcctgtaaatccttcacgtgaaattgaggacccagaagaccggaagcccgaggattgggatgaaagaccaaaaatcccagatccagaagctgtcaagccagatgactgggatgaagatgcccctgctaagattccagatgaagaggccacaaaacccgaaggctggttagatgatgagcctgagtacgtacctgatccagacgcagagaaacctgaggattgggatgaagacatggatggagaatgggaggctcctcagattgccaaccctagatgtgagtcagctcctggatgtggtgtctggcagcgacctgtgattgacaaccccaattataaaggcaaatggaagcctcctatgattgacaatcccagttaccagggaatctggaaacccaggaaaataccaaatccagatttctttgaagatctggaacctttcagaatgactccttttagtgctattggtttggagctgtggtccatgacctctgacattttttttgacaactttatcatttgtgctgatcgaagaatagttgatgattgggccaatgatggatggggcctgaagaaagctgctgatggggctgctgagccaggcgttgtggggcagatgatcgaggcagctgaagagcgcccgtggctgtgggtagtctatattctaactgtagcccttcctgtgttcctggttatcctcttctgctgttctggaaagaaacagaccagtggtatggagtataagaaaactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctcaaaattgataattacgtttaaagtgcagtcatttgtggttagaatcttgttttgtttgcttccattattgagttcctcctaaggaaattgaggagagggactgaatagaagcccaaattcatataaaagttgcgtttaagttgtattaaaaatagatatataagaaaaaattctttcacttgatgtttgttagaccagaaagtgtgtgtgttctgtagctcagttcccagacagctttttaggtagtggaggaggtggcttcatgtggcacttgggcatttatattccacttgggagggtcaggctgtggccttctggagcaggtggcttgttaaggaatgctagcagggcatggcacgtgagctccggaatagatgtcttcatcacttcttccactgtgtgttgacactgttttccttacctatttcctcagatccccagctttctcctctgctatgcattttcttcacagtgcagcttgcagtccgttgctgaaaatgattataagccctgcataatgttaagctttattgtgattacgtgtatgtttcttctttcttttaagcagacccatacctttccagggtcaaagtacagaatagaatacattgatacaaagtacagaaaaatactttgatttttatccatttcttttactctgtgtaaagacttgagaagtctaattcacaggcaaaccaatacagaattgactgcagttgaacagactagaagtatttgtgggaggagtgacatgaagcatgagttatctgattttttttgtagctgctatatattttaagccttcatttgcaattcatgtaacagttgtgtcataaattacacaataaagcagtcctgttcaaatttttttttaacgtggcttgtagaatttttaaaaaagtgatcttaggtttgttttttcatgcgggatgcagatgggtgctatcagagcctctcccacaccactatagtgtaataatgttattattactctacactgaaacgtattcagagttagatattattttagcttcagttgttctttagaggctttcaaatgtaccgatgatactgtttcttgcactgaatatataaacactccacagtgtttatattgggaagatattgggaaggaaatatatttgtaaaagatgaaggctgtatctatttttttttctttttaaagtttgttcacttaaattcttttgaggatgggatgtatttttcttgctgttcagtgctttttccttttcatctgttgttctgtggtcacagtgaccttagctacatagcagactttcccaaatgtattgattacaaataaacagttgttacttagcaagacctgaaaatatgtctgcaggtttctccttgaagcaaatgtgtgggatcattgcatttccagaaatctgcctccttcaccctccgttgacagtatatgtcatgcctcactttcttctagctgagctttaaatcattagagcttaaattgtcagatcgttcattgcctttccagggttatttagtaaagtttgttgaaaacaaaaacgccttttcttggttcttttttcagttattttgaaggtccagcatcctgattaaatgtctgacacattaatgaatgaccagcagcagctttcagctcttaaaaagacacttatattttgattttacatgctggttacctgttccattgttgtcaaatgcccactctccatcagatgtgttcctccattttcttatccacaaagtactcctcacttttcaatttgtcatgttactaaatggtgttacattaaagccctgtgttaagtgtctgcttttgactgaatttcttcatagtaaccttcagtgtgtgtgtgtgactatgttcaattagtgggttgatcttcgtataattggccactatgtgagagttcactactaggcagaaactattatggacagtgaaataatgacttttatctcaccacgtgagtttgatgcagtcttttctgtctagcccttgcctcttcctgcccatgtgattgcggtgcagtagtttctgttgtataatagtgtggacagcagctcagaaaaggagggaatgctactgataatttgtagataatattctttaagacttaggggaaccattgaactttgaaatttttattagaaaattatttgttcagaatcagactccattattttacatatacttaaatactttaggggtatttttgaaagttagcccagttttttatgtgctattaaattttt

SEQ ID NO: 908 - DNA, 1811 bp, Homo sapiens
cgggaggctagagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaactctgtcagggtggattttatccaaagccaagaaagacgataccgatgatgaaattgccaaatatgatggaaagtgggaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtatgaggttaatttccaaaatggaatagaatgtggtggtgcctatgtgaaactgctttctaaaacaccagaactcaacctggatcagttccatgacaagaccccttatacgattatgtttggtccagataaatgtggagaggactataaactgcacttcatcttccgacacaaaaaccccaaaacgggtatctatgaagaaaaacatgctaagaggccagatgcagatctgaagacctattttactgataagaaaacacatctttacacactaatcttgaatccagataatagttttgaaatactggttgaccaatctgtggtgaatagtggaaatctgctcaatgacatgactcctcctgtaaatccttcacgtgaaattgaggacccagaagaccggaagcccgaggattgggatgaaagaccaaaaatcccagatccagaagctgtcaagccagatgactgggatgaagatgcccctgctaagattccagatgaagaggccacaaaacccgaaggctggttagatgatgagcctgagtacgtacctgatccagacgcagagaaacctgaggattgggatgaagacatggatggagaatgggaggctcctcagattgccaaccctagatgtgagtcagctcctggatgtggtgtctggcagcgacctgtgattgacaaccccaattataaaggcaaatggaagcctcctatgattgacaatcccagttaccagggaatctggaaacccaggaaaataccaaatccagatttctttgaagatctggaacctttcagaatgactccttttagtgctattggtttggagctgtggtccatgacctctgacattttttttgacaactttatcatttgtgctgatcgaagaatagttgatgattgggccaatgatggatggggcctgaagaaagctgctgatggggctgctgagccaggcgttgtggggcagatgatcgaggcagctgaagagcgcccgtggctgtgggtagtctatattctaactgtagcccttcctgtgttcctggttatcctcttctgctgttctggaaagaaacagaccagtggtatggagtataagaaaactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagct

SEQ ID NO: 909 - DNA, 4489 bp, Homo sapiens
cgcggcagcggtggccgaggcctcttggttctgcggcacgtgacggtcgggccgcctccgcctctctctttactgcggcgcggggcaagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaactctgtcagggtggattttatccaaagccaagaaagacgataccgatgatgaaattgccaaatatgatggaaagtgggaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtatgaggttaatttccaaaatggaatagaatgtggtggtgcctatgtgaaactgctttctaaaacaccagaactcaacctggatcagttccatgacaagaccccttatacgattatgtttggtccagataaatgtggagaggactataaactgcacttcatcttccgacacaaaaaccccaaaacgggtatctatgaagaaaaacatgctaagaggccagatgcagatctgaagacctattttactgataagaaaacacatctttacacactaatcttgaatccagataatagttttgaaatactggttgaccaatctgtggtgaatagtggaaatctgctcaatgacatgactcctcctgtaaatccttcacgtgaaattgaggacccagaagaccggaagcccgaggattgggatgaaagaccaaaaatcccagatccagaagctgtcaagccagatgactgggatgaagatgcccctgctaagattccagatgaagaggccacaaaacccgaaggctggttagatgatgagcctgagtacgtacctgatccagacgcagagaaacctgaggattgggatgaagacatggatggagaatgggaggctcctcagattgccaaccctagatgtgagtcagctcctggatgtggtgtctggcagcgacctgtgattgacaaccccaattataaaggcaaatggaagcctcctatgattgacaatcccagttaccagggaatctggaaacccaggaaaataccaaatccagatttctttgaagatctggaacctttcagaatgactccttttagtgctattggtttggagctgtggtccatgacctctgacattttttttgacaactttatcatttgtgctgatcgaagaatagttgatgattgggccaatgatggatggggcctgaagaaagctgctgatggggctgctgagccaggcgttgtggggcagatgatcgaggcagctgaagagcgcccgtggctgtgggtagtctatattctaactgtagcccttcctgtgttcctggttatcctcttctgctgttctggaaagaaacagaccagtggtatggagtataagaaaactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctcaaaattgataattacgtttaaagtgcagtcatttgtggttagaatcttgttttgtttgcttccattattgagttcctcctaaggaaattgaggagagggactgaatagaagcccaaattcatataaaagttgcgtttaagttgtattaaaaatagatatataagaaaaattcccagacagctttttaggtagtggaggaggtggcttcatgtggcacttgggcatttatattccacttgggagggtcaggctgtggccttctggagcaggtggcttgttaaggaatgctagcagggcatggcacgtgagctccggaatagatgtcttcatcacttcttccactgtgtgttgacactgttttccttacctatttcctcagatccccagctttctcctctgctatgcattttcttcacagtgcagcttgcagtccgttgctgaaaatgattataagccctgcataatgttaagctttattgtgattacgtgtatgtttcttctttcttttaagcagacccatacctttccagggtcaaagtacagaatagaatacattgatacaaagtacagaaaaatactttgatttttatccatttcttttactctgtgtaaagacttgagaagtctaattcacaggcaaaccaatacagaattgactgcagttgaacagactagaagtatttgtgggaggagtgacatgaagcatgagttatctgattttttttgtagctgctatatattttaagccttcatttgcaattcatgtaacagttgtgtcataaattacacaataaagcagtcctgttcaaatttttttttaacgtggcttgtagaatttttaaaaaagtgatcttaggtttgttttttcatgcgggatgcagatgggtgctatcagagcctctcccacaccactatagtgtaataatgttattattactctacactgaaacgtattcagagttagatattattttagcttcagttgttctttagaggctttcaaatgtaccgatgatactgtttcttgcactgaatatataaacactccacagtgtttatattgggaagatattgggaaggaaatatatttgtaaaagatgaaggctgtatctatttttttttctttttaaagtttgttcacttaaattcttttgaggatgggatgtatttttcttgctgttcagtgctttttccttttcatctgttgttctgtggtcacagtgaccttagctacatagcagactttcccaaatgtattgattacaaataaacagttgttacttagcaagacctgaaaaaatctgcctccttcaccctccgttgacagtatatgtcatgcctcactttcttctagctgagctttaaatcattagagcttaaattgtcagatcgttcattgcctttccagggttatttagtaaagtttgttgaaaacaaaaacgccttttcttggttcttttttcagttattttgaaggtccagcatcctgattaaatgtctgacacattaatgaatgaccagcagcagctttcagctcttaaaaagacacttatattttgattttacatgctggttacctgttccattgttgtcaaatgcccactctccatcagatgtgttcctccattttcttatccacaaagtactcctcacttttcaatttgtcatgttactaaatggtgttacattaaagccctgtgttaagtgtctgcttttgactgaatttcttcatagtaaccttcagtgtgtgtgtgtgactatgttcaattagtgggttgatcttcgtataattggccactatgtgagagttcactactaggcagaaactattatggacagtgaaataatgacttttatctcaccacgtgagtttgatgcagtcttttctgtctagcccttgcctcttcctgcccatgtgattgcggtgcagtagtttctgttgtataatagtgtggacagcagctcagaaaaggagggaatgctactgataatttgtagataatattctttaagacttaggggaaccattgaactttgaaatttttattagaaaattatttgttcagaatcagactccattattttacatatacttaaatactttaggggtatttttgaaagttagcccagttttttatgtgctattaaattttt

SEQ ID NO: 910 - DNA, 1986 bp, Homo sapiens
gcgccggagcccaaaaacaaggactgcgcacgcgcggcggcaaggcccgggcattttgctgcgtcaccagccgccgcccggcctcaccacccctcgtttgcacgcacgcacgttcattctccgtcctcgcgccccttttcctacactttcctcttctccccgaccggaggagccgctctttccgcgcggtgcattctggggcccgaggtcgagcccgccgctgccgccgtcgcctgagggaagcgagaagaggccgcgaccggagagaaaaagcggagtcgccaccggagagaagtcgactccctagcagcagccgccgccagagaggcccgcccaccagttcgcccgtccccctgccccgttcacaatgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagcttaattggcttagtgtcgacttcaataattggaaagactgggaagatgattcagatgaagacatgtctaattttgatcgtttctctgagatgatgaacaacatgggtggtgatgaggatgtagatttaccagaagtagatggagcagatgatgattcacaagacagtgatgatgaaaaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataaactgttggaagacttcttggctgtccttttaagtgtctggcttactgtaatttttatgtatttaccatttactggaatggagtttatttgaggaagaatttgggattattcctctgtttgaaaaaagaggcttgctgtaatgtcacaggaaaccttttaaaagtggatctgtaatagcatattgtagatgcactttgcagcagttggaaaagaaagtgttgtgtgatttgattgaaataaaactaaatgtgttgtcctcctaaatctttg

SEQ ID NO: 911 - DNA, 782 bp, Homo sapiens
ggattcgggctacactttcctcttctccccgaccggagagccgctctttccgcgcggtgcattctggggcccgaggtcgagcccgccgctgccgccgtcgcctgagggaagcgagaagaggccgcgaccgagagaaaaagcggagtcgcaccggagagaagtcgactccctagcagcagccgccgccagagagcccgcccaccagttcgcccgtccccctgccccgttcacaatgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagcttaattggcttagtgtcgacttcaataattggaaagactgggaagatgattcagatgaagacatgtctaattttgatcgtttctctgagatgatgaacaacatgggtggtgatgaggatgtagatttaccagaagtagatggagcagatgatgattcacaagacagtgatgatgaaaaaatgccagatctggagtaaggaatattgtcatcacctggattttgagaaagaaaaataacttctctgcaagatttcataattgaga

SEQ ID NO: 912 - DNA, 2483 bp, Homo sapiens
ccggcctcaccacccctcgtttgcacgcacgcacgttcattctccgtcctcgcgccccttttcctacactttcctcttctccccgaccggaggagccgctctttccgcgcggtgcattctggggcccgaggtcgagcccaagcggagtcgccaccggagagaagtcgactccctagcagcagccgccgccagagaggcccgcccaccagttcgcccgtccccctgccccgttcacaatgtgagtgcgacaccccgccgagggaaggtcgccgagtgaggccgaggccgcgttgggggctccctggaagcggccccctagcctttctcgcatcggtggtggcagtcgttcctgcctgggggcgggaggtccaggatccttgttccggttaccgttggcgggtggaggacatttttcctccagatgtctgcttcccccacccctgaaccgttccttggcttccccatgccggaaatcctacttttacccctttggctgtctgggctactcgcctctttcggtaacttcaccctaggccttaagctcccggtagctgctcgccatgcggcgccctgaagcgtgaaccttcgtgggtcgcctctcggctgcttgggcgctccggttctgttgctttgtggtcccggggccaggccctgagtcgagtgcacctgtggtgggtgccgccaggtgcctggcggagctcctgggagagccccacgcggacctcgccgtgagctgcaggtactgctaggcaactagaaggaagccatgcccacgccgcaacatacttccctctccagtgtctgggtttcttgagtgtgggtacttccagtccgcctcctaactccagtctcttgaaaacacgggaggttgccaaaactcagccgcttccctggcagcgaggaggagttaccattgagcaggtagttccgcacgtgtcgactttggaaagatacggacattttctgtgtttcatgttctacttgaggcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagcttaattggcttagtgtcgacttcaataattggaaagactgggaagatgattcagatgaagacatgtctaattttgatcgtttctctgagatgatgaacaacatgggtggtgatgaggatgtagatttaccagaagtagatggagcagatgatgattcacaagacagtgatgatgaaaaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgtttttcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataaactgttggaagacttcttggctgtccttttaagtgtctggcttactgtaatttttatgtatttaccatttactggaatggagtttatttgaggaagaatttgggattattcctctgtttgaaaaaagaggcttgctgtaatgtcacaggaaaccttttaaaagtggatctgtaatagcatattgtagatgcactttgcagcag

SEQ ID NO: 913 - DNA, 1759 bp, Homo sapiens
agcccgccgctgccgccgtcgcctgagggaagcgagaagaggccgcgaccggagagaaaaagcggagtcgccaccggagagaacagccgccgccagagaggcccgcccaccagttcgcccgtccccctgccccgttcacaatgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagcttaattggcttagtgtcgacttcaataattggaaagactgggaagatgattcagatgaagacatgtctaattttgatcgtttctctgagatgatgaacaacatgggtggtgatgaggatgtagatttaccagaagtagatggagcagatgatgattcacaagacagtgatgatgaaaaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataaactgttggaagacttcttggctgtccttttaagtgtctggcttactgtaatttttatgtatttaccatttactggaatggagtttatttgaggaagaatttgggattattcctctgtttgaaaaaagaggcttgctgtaatgtcacaggaaaccttttaaaagtggatctgtaatagcatattgtagatgcactttgcagcagttggaaaagaaagtgttgtgtgatttgattgaaataaaactaaatgtgttgtcctcctaaatctttg

SEQ ID NO: 914 - DNA, 1735 bp, Homo sapiens
ccggcctcaccacccctcgtttgcacgcacgcacgttcattctccgtcctcgcgccccttttcctacactttcctcttctccccgaccggaggagccgctctttccgcgcggtgcattctggggcccgaggtcgagcccaagcggagtcgccaccggagagaagtcgactccctagcagcagccgccgccagagaggcccgcccaccagttcgcccgtccccctgccccgttcacaatgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagcttaattggcttagtgtcgacttcaataattggaaagactgggaagatgattcagatgaagacatgtctaattttgatcgtttctctgagatgatgaacaacatgggtggtgatgaggatgtagatttaccagaagtagatggagcagatgatgattcacaagacagtgatgatgaaaaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgtttttcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataaactgttggaagacttcttggctgtccttttaagtgtctggcttactgtaatttttatgtatttaccatttactggaatggagtttatttgaggaagaatttgggattattcctctgtttgaaaaaagaggcttgctgtaatgtcacaggaaaccttttaaaagtggatctgtaatagcatattgtagatgcactttgcagcag

SEQ ID NO: 915 - DNA, 922 bp, Homo sapiens
gaggcattcattctttcctttctgtgggtgtggggaggggaccacagggcacataccccaccctgggatccagctgagcaggggggtcagagatgacagctcttccggctcacaggccaccggcccacatacagggcaatcagaagaaagaaacagcacaaggaaggcacagagggagtcgttgtccctgccagaggcccagcagccaccacagcgcctgcttcctcggccctgaaatcatgcccctaggtctcctgtggctgggcctagccctgttgggggctctgcatgcccaggcccaggactccacctcagacctgatcccagccccacctctgagcaaggtccctctgcagcagaacttccaggacaaccaattccaggggaagtggtatgtggtaggcctggcagggaatgcaattctcagagaagacaaagacccgcaaaagatgtatgccaccatctatgagctgaaagaagacaagagctacaatgtcacctccgtcctgtttaggaaaaagaagtgtgactactggatcaggacttttgttccaggttgccagcccggcgagttcacgctgggcaacattaagagttaccctggattaacgagttacctcgtccgagtggtgagcaccaactacaaccagcatgctatggtgttcttcaagaaagtttctcaaaacagggagtacttcaagatcaccctctacgggagaaccaaggagctgacttcggaactaaaggagaacttcatccgcttctccaaatctctgggcctccctgaaaaccacatcgtcttccctgtcccaatcgaccagtgtatcgacggctgagtgcacaggtgcctcccatctgccgcaccagcccgaacaccattgagggagctgggagaccctccccacagtgccacccatgcagc

SEQ ID NO: 916 - DNA, 813 bp, Homo sapiens
actcgccacctcctcttccacccctgccaggcccagcagccaccacagcgcctgcttcctcggccctgaaatcatgcccctaggtctcctgtggctgggcctagccctgttgggggctctgcatgcccaggcccaggactccacctcagacctgatcccagccccacctctgagcaaggtccctctgcagcagaacttccaggacaaccaattccaggggaagtggtatgtggtaggcctggcagggaatgcaattctcagagaagacaaagacccgcaaaagatgtatgccaccatctatgagctgaaagaagacaagagctacaatgtcacctccgtcctgtttaggaaaaagaagtgtgactactggatcaggacttttgttccaggttgccagcccggcgagttcacgctgggcaacattaagagttaccctggattaacgagttacctcgtccgagtggtgagcaccaactacaaccagcatgctatggtgttcttcaagaaagtttctcaaaacagggagtacttcaagatcaccctctacgggagaaccaaggagctgacttcggaactaaaggagaacttcatccgcttctccaaatctctgggcctccctgaaaaccacatcgtcttccctgtcccaatcgaccagtgtatcgacggctgaggtgccgccagctgccgcaccagcccgaacaccattgagggagctgggagaccctccccacagtgccacccatgcagctgctccccaggccaccccgctgatggagccccaccttgtctgctaaataaacatgtgccctcagg

SEQ ID NO: 917 - DNA, 992 bp, Homo sapiens
gcccagcagccaccacagcgcctgcttcctcggccctgaaatcatgcccctaggtctcctgtggctgggcctagccctgttgggggctctgcatgcccaggcccaggactccacctcagacctgatcccagccccacctctgagcaaggtccctctgcagcagaacttccaggacaaccaattccaggggaagtggtatgtggtaggcctggcagggaatgcaattctcagagaagacaaagacccgcaaaagatgtatgccaccatctatgagctgaaagaagacaagagctacaatgtcacctccgtcctgtttaggaaaaagaagtgtgactactggatcaggacttttgttccaggttgccagcccggcgagttcacgctgggcaacattaagagttaccctggattaacgagttacctcgtccgagtggtgagcaccaactacaaccagcatgctatggtgttcttcaagaaagtttctcaaaacagggagtacttcaagatcaccctctacgggagaaccaaggagctgacttcggaactaaaggagaacttcatccgcttctccaaatctctgggcctccctgaaaaccacatcgtcttccctgtcccaatcggtaatggccagtctggatgaggggacggggacatggggactgttcaggcaggatgcttccctaccagggatcagggagaggagggactccgtcctcagcttcagtcactggagcagtggatggtccaggagctccttggaagccactctgggcccaggaagactgtgccccaccccagggtctatgggactcccagggacccaggccgcaagtgctctttcctggcagtttagcccgggtctgcccagacaaggatttcaggcccaggcctgagtatccatttctcagtctcactggcctgacacctctggccaccctcccaggcccccttgttctgggccatctcccccgaccctcccaggcctcgtcacc

SEQ ID NO: 918 - DNA, 845 bp, Homo sapiens
caggtgagcctctcactcgccacctcctcttccacccctgccaggcccagcagccaccacagcgcctgcttcctcggccctgaaatcatgcccctaggtctcctgtggctgggcctagccctgttgggggctctgcatgcccaggcccaggactccacctcagacctgatcccagccccacctctgagcaaggtccctctgcagcagaacttccaggacaaccaattccaggggaagtggtatgtggtaggcctggcagggaatgcaattctcagagaagacaaagacccgcaaaagatgtatgccaccatctatgagctgaaagaagacaagagctacaatgtcacctccgtcctgtttaggaaaaagaagtgtgactactggatcaggacttttgttccaggttgccagcccggcgagttcacgctgggcaacattaagagttaccctggattaacgagttacctcgtccgagtggtgagcaccaactacaaccagcatgctatggtgttcttcaagaaagtttctcaaaacagggagtacttcaagatcaccctctacgggagaaccaaggagctgacttcggaactaaaggagaacttcatccgcttctccaaatctctgggcctccctgaaaaccacatcgtcttccctgtcccaatcgaccagtgtatcgacggctgagtgcacaggtgccgccagctgccgcaccagcccgaacaccattgagggagctgggagaccctccccacagtgccacccatgcagctgctccccaggccaccccgctgatggagccccaccttgtctgctaaataaacatgtgccctcaggccaaaaagaaa

SEQ ID NO: 919 - DNA, 1188 bp, Homo sapiens
gaggcattcattctttcctttctgtgggtgtggggaggggaccacagggcacataccccaccctgggatccagctgagcaggggggtcagagatgacagctcttccggctcacaggccaccggcccacatacagggcaatcagaagaaagaaacagcacaaggaaggcacagagggagtcgttgtccctgccagaggcccagcagccaccacagcgcctgcttcctcggccctgaaatcatgcccctaggtctcctgtggctgggcctagccctgttgggggctctgcatgcccaggcccaggactccacctcagacctgatcccagccccacctctgagcaaggtccctctgcagcagaacttccaggacaaccaattccaggggaagtggtatgtggtaggcctggcagggaatgcaattctcagagaagacaaagacccgcaaaagatgtatgccaccatctatgagctgaaagaagacaagagctacaatgtcacctccgtcctgtttaggaaaaagaagtgtgactactggatcaggacttttgttccaggttgccagcccggcgagttcacgctgggcaacattaagagttaccctggattaacgagttacctcgtccgagtggtgagcaccaactacaaccagcatgctatggtgttcttcaagaaagtttctcaaaacagggagtacttcaagatcaccctctacgggagaaccaaggagctgacttcggaactaaaggagaacttcatccgcttctccaaatctctgggcctccctgaaaaccacatcgtcttccctgtcccaatcggtaatggccagtctggatgaggggacggggacatggggactgttcaggcaggatgcttccctaccagggatcagggagaggagggactccgtcctcagcttcagtcactggagcagtggatggtccaggagctccttggaagccactctgggcccaggaagactgtgccccaccccagggtctatgggactcccagggacccaggccgcaagtgctctttcctggcagtttagcccgggtctgcccagacaaggatttcaggcccaggcctgagtatccatttctcagtctcactggcctgacacctctggccaccctcccaggcccccttgttctgggccatctcccccgaccctcccaggcctcgtcacc

SEQ ID NO: 920 - DNA, 822 bp, Homo sapiens
tcttccacccctgccaggcccagcagccaccacagcgcctgcttcctcggccctgaaatcatgcccctaggtctcctgtggctgggcctagccctgttgggggctctgcatgcccaggcccaggactccacctcagacctgatcccagccccacctctgagcaaggtccctctgcagcagaacttccaggacaaccaattccaggggaagtggtatgtggtaggcctggcagggaatgcaattctcagagaagacaaagacccgcaaaagatgtatgccaccatctatgagctgaaagaagacaagagctacaatgtcacctccgtcctgtttaggaaaaagaagtgtgactactggatcaggacttttgttccaggttgccagcccggcgagttcacgctgggcaacattaagagttaccctggattaacgagttacctcgtccgagtggtgagcaccaactacaaccagcatgctatggtgttcttcaagaaagtttctcaaaacagggagtacttcaagatcaccctctacgggagaaccaaggagctgacttcggaactaaaggagaacttcatccgcttctccaaatctctgggcctccctgaaaaccacatcgtcttccctgtcccaatcgaccagtgtatcgacggctgagtgcacaggtgccgccagctgccgcaccagcccgaacaccattgagggagctgggagaccctccccacagtgccacccatgcagctgctccccaggccaccccgctgatggagccccaccttgtctgctaaataaacatgtgccctcaaaaaaaaaaaaaaaaaa

SEQ ID NO: 921 - DNA, 2498 bp, Homo sapiens
cgccgcgcttcctcctgaaggtgactgcgcccgcggggacgcagggggcggggcccgggtcgcccggagccgggattgggcagagggcggggcggcggagggattgcggcggcccgcagcgggataaccttgaggctgaggcagtggctccttgcacagcagctgcacgcgccgtggctccggatctcttcgtctttgcagcgtagcccgagtcggtcagcgccggaggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgaccccatcctctaccggcccgttgctgtggctctagacactaaaggacctgagatccgaactgggctcatcaagggcagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgatagctcgtgaggctgaggcagccatgttccaccgcaagctgtttgaagaacttgtgcgagcctcaagtcactccacagacctcatggaagccatggccatgggcagcgtggaggcttcttataagtgtttagcagcagctttgatagttctgacggagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagcaccaaaaaaaaaaaaaaaaaaaaaaaaaaaaaaaaaaaaaaaa

SEQ ID NO: 922 - DNA, 2490 bp, Homo sapiens
tcgtctttgcagcgtagcccgagtcggtcagcgccggaggtgagcggtgcaggaggctacgccatcagtccccaccaagggccagtcgcccggctagtgcggaatcccggcgcgccggccggccccgggcacgcaggcagggcggcgcaggatccagggcgtctgggatgcagtggagctcagagagaggagaacggctcctcacgcctggggcctgctcttcagaagtccccagcgccgttccttccagatcaggcgggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgaccccatcctctaccggcccgttgctgtggctctagacactaaaggacctgagatccgaactgggctcatcaagggcagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgatagctcgtgaggctgaggcagccatgttccaccgcaagctgtttgaagaacttgtgcgagcctcaagtcactccacagacctcatggaagccatggccatgggcagcgtggaggcttcttataagtgtttagcagcagctttgatagttctgacggagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagcacct

SEQ ID NO: 923 - DNA, 2498 bp, Homo sapiens
ccaccgaaagggcaacctgcccgcgcgttccgccgccgccgccgcgcttcctcctgaaggtgactgcgcccgcggggacgcagggggcggggcccgggtcgcccggagccgggattgggcagagggcggggcggcggagggattgcggcggcccgcagcgggataaccttgaggctgaggcagtggctccttgcacagcagctgcacgcgccgtggctccggatctcttcgtctttgcagcgtagcccgagtcggtcagcgccggaggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgaccccatcctctaccggcccgttgctgtggctctagacactaaaggacctgagatccgaactgggctcatcaagggcagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgattgcccgtgaggcagaggctgccatctaccacttgcaattatttgaggaactccgccgcctggcgcccattaccagcgaccccacagaagccaccgccgtgggtgccgtggaggcctccttcaagtgctgcagtggggccataatcgtcctcaccaagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagcacct

SEQ ID NO: 924 - DNA, 2392 bp, Homo sapiens
agcgggataaccttgaggctgaggcagtggctccttgcacagcagctgcacgcgccgtggctccggatctcttcgtctttgcagcgtagcccgagtcggtcagcgccggagatgactcaacctttcaattattctgcttttgagagaattatcttcgctgggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgaccccatcctctaccggcccgttgctgtggctctagacactaaaggacctgagatccgaactgggctcatcaagggcagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgattgcccgtgaggcagaggctgccatctaccacttgcaattatttgaggaactccgccgcctggcgcccattaccagcgaccccacagaagccaccgccgtgggtgccgtggaggcctccttcaagtgctgcagtggggccataatcgtcctcaccaagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagcacct

SEQ ID NO: 925 - DNA, 2479 bp, Homo sapiens
cgccgcgcttcctcctgaaggtgactgcgcccgcggggacgcagggggcggggcccgggtcgcccggagccgggattgggcagagggcggggcggcggagggattgcggcggcccgcagcgggataaccttgaggctgaggcagtggctccttgcacagcagctgcacgcgccgtggctccggatctcttcgtctttgcagcgtagcccgagtcggtcagcgccggaggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgaccccatcctctaccggcccgttgctgtggctctagacactaaaggacctgagatccgaactgggctcatcaagggcagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgattgcccgtgaggcagaggctgccatctaccacttgcaattatttgaggaactccgccgcctggcgcccattaccagcgaccccacagaagccaccgccgtgggtgccgtggaggcctccttcaagtgctgcagtggggccataatcgtcctcaccaagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagcaccaaaaaaaaaaaaaaaaaaaaa

SEQ ID NO: 926 - DNA, 2498 bp, Homo sapiens
ccaccgaaagggcaacctgcccgcgcgttccgccgccgccgccgcgcttcctcctgaaggtgactgcgcccgcggggacgcagggggcggggcccgggtcgcccggagccgggattgggcagagggcggggcggcggagggattgcggcggcccgcagcgggataaccttgaggctgaggcagtggctccttgcacagcagctgcacgcgccgtggctccggatctcttcgtctttgcagcgtagcccgagtcggtcagcgccggaggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgaccccatcctctaccggcccgttgctgtggctctagacactaaaggacctgagatccgaactgggctcatcaagggcagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgatagctcgtgaggctgaggcagccatgttccaccgcaagctgtttgaagaacttgtgcgagcctcaagtcactccacagacctcatggaagccatggccatgggcagcgtggaggcttcttataagtgtttagcagcagctttgatagttctgacggagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagcacct

SEQ ID NO: 927 - DNA, 2287 bp, Homo sapiens
ggctgaggcagtggctccttgcacagcagctgcacgcgccgtggctccggatcttcttcgtctttgcagcgtagcccgagtcggtcagcgccagaggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgaccccatcctctaccggcccgttgctgtggctctagacactaaaggacctgagatccgaactgggctcatcaagggcagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagaacctgattgcccgtgaggcagaggctgccatctaccacttgcaattatttgaggaactccgccgcctggcgcccattaccagcgaccccacagaagccaccgccgtgggtgccgtggaggcctccttcaagtgctgcagtggggccataatcgtcctcaccaagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccagagcctggctgccccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccattttcccccactactgcagcacctccaggcctgttgccgc

SEQ ID NO: 928 - DNA, 2117 bp, Homo sapiens
ggcagtggctccttgcacagcagctgcacgcgccgtggctccggatctcttcgtctttgcagcgtagcccgagtcggtcagcgccggaggtgagcgccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgaccccatcctctaccggcccgttgctgtggctctagacactaaaggacctgagatccgaactgggctcatcaagggcagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggcagtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcaggcatatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgattgcccgtgaggcagaggctgccatctaccacttgcaattatttgaggaactccgccgcctggcgcccattaccagcgaccccacagaagccaccgccgtgggtgccgtggaggcctccttcaagtgctgcagtggggccataatcgtcctcaccaagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccatggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaccgactctggccctggcccttacttgcttctctagctctctaggcctctccagtttgcacctgtccccaccctccactcagctgtcctgcagcaaacactccaccctccaccttccattttcccccactactgcag

SEQ ID NO: 929 - DNA, 2332 bp, Homo sapiens
gcacagcagctgcacgcgccgtggctccggatctcttcgtctttgcagcgtagcccgagtcggtcagcgccggaggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgaccccatcctctaccggcccgttgctgtggctctagacactaaaggacctgagatccgaactgggctcatcaagggcagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgattgcccgtgaggcagaggctgccatctaccacttgcaattatttgaggaactccgccgcctggcgcccattaccagcgaccccacagaagccaccgccgtgggtgccgtggaggcctccttcaagtgctgcagtggggccataatcgtcctcaccaagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagcaaaaaaaaaaaaaaaaaaaaaaaaaaaaaa

SEQ ID NO: 930 - DNA, 1863 bp, Homo sapiens
gtcagcactggaggacctcagcagccatgttgaagccccatagtgaagccgggactgccttcattcagacccagcagctacatgcagccacggctgacacattcctggagcacatgtgccacctggacattcacacaccacccatcccagcctggaacactggcatcatctgtaccattagcccagcttcccaatcggtggagatgttgaaggagatgattaagtctggaacgaatgtggcttgtctgaacttctctcatggaactcatgagtaccacgtggagaccatcaagaacatgtgcacagccacggaaagctttgctgctgaccccatcctctaccggcctgttgctttggctctggatactaaaggacctgagatccgaactgggctcatcaagggcagcagcaccatggaggtggggctgaagatgggagccactctcaaaatcatgctggataacacctacatgaaaaagtgtgacgagaacatcctgtggctggactacaagaacatctgcaaggtgatggaagtgggcagcaagatctacgtggatgatgggcttatttctctccaggtaaagcagaaaggtgctgacttcctggtgacggaggtggaaactggtggttcctcgggcagcaagaagggtgtgaaccttcctggggctgctgtggacttgcctgctgtgtcagaggacatccaggacctgaattttggggtcgagcaggatgtcgatatggtgtttgcgtcgttcatccgcaaggcatctgatgtccatgaagttagggaggccctgggagagaagggaaagaacatcaagacaatcaacacaatcgagaatcatgtgggggttcagaggtttgatgaaatcctagaggccagtgatgggatcatggtggctcgtggtaatccaggcattgagattcctgcagagaaggtcttccttgctcagaggatgatgattgggcgttgcagctgagctgggaagcctatctgtgacagtgatgtggccagtgcagtactgaatggagccgactgcatcatgctgtctggagaaacagccaaagcggactatctggaggctgggcgcatgcagcacctgattgcccatgaggcagaggccaccatctaccacttgcaattatttgaggaactcccacccactggcgcccattactagcgaccccacgaaagccaccgccgtgggtgccaacgaggcctccttcaagtgctgcagtggggccataatcgtcctcaccaagtctggcaggtctgctcaccaggtggctagataccgcccacgtgcccccatcattgctgtgacacggaatccccagacagctagtcaggcccacctgtaccgtggcatcttccctgtgctgtgcaaggacccagtccaggaggccagggctgaggatgtggaccgctgggtgaacttggccctgaatgttggcaaggcccgaggcttctttaagaagggagacatgtggtcattgtgctgaccgggtggcgccctggctctggcttcaccaacaccatgcgtgttgttcctgtgcggtgatggaccccaaagcccctgctccagcgcctgtcccacctcctttccccgaaccatccattaggccaacaacgcttgggccttagggcacaggacagttcttccatttaagtactctggcctgacccttacttgcttccccaaacccctgggcctccccaatttgcgcctgtccccaccctccactcagctgtcctgcggcaaacactccaccctccaccttccattttcccccactactgcagcacctccgggcctgttgctatagagcctacctgtatatcaataaacaacagctgaagtt

SEQ ID NO: 931 - DNA, 2117 bp, Homo sapiens
ggcagtggctccttgcacagcagctgcacgcgccgtggctccggatctcttcgtctttgcagcgtagcccgagtcggtcagcgccggaggtgagcgccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgaccccatcctctaccggcccgttgctgtggctctagacactaaaggacctgagatccgaactgggctcatcaagggcagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggcagtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcaggcatatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgatagctcgtgaggctgaggcagccatgttccaccgcaagctgtttgaagaacttgtgcgagcctcaagtcactccacagacctcatggaagccatggccatgggcagcgtggaggcttcttataagtgtttagcagcagctttgatagttctgacggagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccatggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaccgactctggccctggcccttacttgcttctctagctctctaggcctctccagtttgcacctgtccccaccctccactcagctgtcctgcagcaaacactccaccctccaccttccattttcccccactactgcag

SEQ ID NO: 932 - DNA, 776 bp, Homo sapiens
ctattcatcaagtctggcaagtctgctcaccaggtggccagatatcacccacatgcccccatcattgctgtgacacggaatccccagacagctcgttaggcccacctgtaccgtggcatcttccctgtgctgtgcaaggacccagtccaagaggcctgggctgaggacgtggacctccgggtgaacttggccatgaatgttggcaaggcccaagccttcttcaagaagggagatgtggtcattgtgctgaccgggtggcaccctggctccggcttcaccaacaccatgtgtgttgttcctgtgccgtgatggaccccagagcccctcctccagctcctgtcccacccccttcccccaacccatccattaggccagcaacgcttgtagagctcactgtgggctgtaatgtggcactggtgggctgggacaccagggaagaagatcaatgcctcgctgaaacatggctgtgtttacagcctgctccagtgggacagcccagagcctggctgcccatcatgtggccccacccaatcaagggaagaaggaggaatgctggactggaggccccaggagccagatggcaagagggtgacagcttcctttcttgtgtttactctgttcagttcctttagaaaatggatgcccagaggactcccaactctggcctggggtcaggaaacagccagcgagagttaggggccttagggcacagggcagttgctccactgaagcagactctggccctggcccttacttgcttcctcaaccccctgggc

SEQ ID NO: 933 - DNA, 2004 bp, Homo sapiens
tgaaagtgggcacagctgctgcacatcccggggctcctgacctctctgcgtttgcagcgtagcccaagtcggtcagcactggaggacctcagaagccatgttgaagccccatagtgaagccagggctgccttcattcagacccagcagctgcacgcagccatggctgacacattcttggagcacatgtgctgcctggacactgactcgccacccatcacagcctggagcactggcatcatccgtactatgggcccagcttctccattgctagagatgctgaagaaaacgattaagtctggaattaatgtggctcatctgaactctcatggagcccatgagtaccatacagagaccatcaagaacgtgcgcacagccacggaaagctttgcttctgactccatcctctaccagcccattgctgtggctccagacactaaaggacctgagatcccaactgggcccgtcaagggcagcggcactgcagaggtggagctgaagaagggagccactctcaagttcacgctggataatacctacatggaaaagggtaagagaacatcctgtggcgggactacaagaacatctgcaaggtggtggaagtgggctgcaagatctacgtggatgatgggctaatttctctccaagtgaagcagaaggatgctcactttctggtgacagaggtggaaaatggtggctccttgggcagcaagaagagtgtgaaccttcctggggctgccgtggacctgcctgccatgttggagaaggacatccaggacctgaagtttgggggcgagcaagatgtcgatatgatgttttcatcattcatctgcaagacatctgatgtccatgaagttaggaaggtcttgggagagaaaggaaagaacagcaagataaccagcaaaattgagaatcatgatgggggttggaggtttgatgaaatcctggaggccagcgatgggattatggtagctcgtggtgatccaccacaagccgtcgagatgagattcctgcagggaaggtctgccttgctcagaggatgatgattgggtggtgcaaccaagctgggaagcctgtcatcttgccactcagatgctagaggatgtgatcaagaagctccaccccacttgggctgagggcagtggtgtggccaatgcagttctggtggaagctgactgcatcatgctgtctggagaaacagccaaagggaactatcctctggaggctgtgcacatgcagcacctgattgcctgtgaggcagaggccaccatctaccacttgcaattatttgaggagttctgccacctggcacccattaccagtgaccccgcagaagctactgccgtgggcactgtggaggcctccttcaagtgctgcagtggggccataatcgtcctcaccaagtctgcaggtgtgcccaccaggtggccagatactgcccacgtgcccccatgattgttgtgacatggcatccccaggcagctcgccaggcccacctgtaccgtggtatcttccctgtgctgtgtaaggaccccatccaggagccctaggctgaggatgtggacctccgagtgaacttggccatgaatgttggtaaggcctgaggcttcttcaagaaggatgatgtggtcattgtgctgacctggtgacaccctggccctggcttctccaccaccctgtgtgttattcctgtgctgtgatggactccagagctcttcctccagcccctgtcccacccccttcccccaatgcatccattaggccagcaatgcttatagagctcactctgggctgtagtgtggcactggtgggctggaacaccagggaagaagatttatgcctcgctgaaacgtggctgtttttagagcctgctgtggcgggagagcccggagcctggctgcccatcatgtggccccacccaagcaagagaagaaggaggaatgcagaacagaggcccccagagtgtatggcaagagggtggcagcttcctttcttctgtgtactct

SEQ ID NO: 934 - DNA, 4632 bp, Homo sapiens
ttctgctgggcctcaggtgagactgcagctccagtcatcatcttgattgcagcccacagaaactaccaacccacagaaactgtaggtagagcaagaagatggtgtttctgcccctcaaatggtcccttgcaaccatgtcatttctactttcctcactgttggctctcttaactgtgtccactccttcatggtgtcagagcactgaagcatctccaaaacgtagtgatgggacaccatttccttggaataaaatacgacttcctgagtacgtcatcccagttcattatgatctcttgatccatgcaaaccttaccacgctgaccttctggggaaccacgaaagtagaaatcacagccagtcagcccaccagcaccatcatcctgcatagtcaccacctgcagatatctagggccaccctcaggaagggagctggagagaggctatcggaagaacccctgcaggtcctggaacacccccctcaggagcaaattgcactgctggctcccgagcccctccttgtcgggctcccgtacacagttgtcattcactatgctggcaatctttcggagactttccacggattttacaaaagcacctacagaaccaaggaaggggaactgaggatactagcatcaacacaatttgaacccactgcagctagaatggcctttccctgctttgatgaacctgccttcaaagcaagtttctcaatcaaaattagaagagagccaaggcacctagccatctccaatatgccattggtgaaatctgtgactgttgctgaaggactcatagaagaccattttgatgtcactgtgaagatgagcacctatctggtggccttcatcatttcagattttgagtctgtcagcaagataaccaagagtggagtcaaggtttctgtttatgctgtgccagacaagataaatcaagcagattatgcactggatgctgcggtgactcttctagaattttatgaggattatttcagcataccgtatcccctacccaaacaagatcttgctgctattcccgactttcagtctggtgctatggaaaactggggactgacaacatatagagaatctgctctgttgtttgatgcagaaaagtcttctgcatcaagtaagcttggcatcacaatgactgtggcccatgaactggcccaccagtggtttgggaacctggtcactatggaatggtggaatgatctttggctaaatgaaggatttgccaaatttatggagtttgtgtctgtcagtgtgacccatcctgaactgaaagttggagattatttctttggcaaatgttttgacgcaatggaggtagatgctttaaattcctcacaccctgtgtctacacctgtggaaaatcctgctcagatccgggagatgtttgatgatgtttcttatgataagggagcttgtattctgaatatgctaagggagtatcttagcgctgacgcatttaaaagtggtattgtacagtatctccagaagcatagctataaaaatacaaaaaacgaggacctgtgggatagtatggcaagtatttgccctacagatggtgtaaaagggatggatggcttttgctctagaagtcaacattcatcttcatcctcacattggcatcaggaaggggtggatgtgaaaaccatgatgaacacttggacactgcagaggggttttcccctaataaccatcacagtgagggggaggaatgtacacatgaagcaagagcactacatgaagggctctgacggcgccccggacactgggtacctgtggcatgttccattgacattcatcaccagcaaatccgacatggtccatcgatttttgctaaaaacaaaaacagatgtgctcatcctcccagaagaggtggaatggatcaaatttaatgtgggcatgaatggctattacattgtgcattacgaggatgatggatgggactctttgactggccttttaaaaggaacacacacagcagtcagcagtaatgatcgggcaagtctcattaacaatgcatttcagctcgtcagcattgggaagctgtccattgaaaaggccttggatttatccctgtacttgaaacatgaaactgaaattatgcccgtgtttcaaggtttgaatgagctgattcctatgtataagttaatggagaaaagagatatgaatgaagtggaaactcaattcaaggccttcctcatcaggctgctaagggacctcattgataagcagacatggacagacgagggctcagtctcagagcgaatgctgcggagtgaactactactcctcgcctgtgtgcacaactatcagccgtgcgtacagagggcagaaggctatttcagaaagtggaaggaatccaatggaaacttgagcctgcctgtcgacgtgaccttggcagtgtttgctgtgggggcccagagcacagaaggctgggattttctttatagtaaatatcagttttctttgtccagtactgagaaaagccaaattgaatttgccctctgcagaacccaaaataaggaaaagcttcaatggctactagatgaaagctttaagggagataaaataaaaactcaggagtttccacaaattcttacactcattggcaggaacccagtaggatacccactggcctggcaatttctgaggaaaaactggaacaaacttgtacaaaagtttgaacttggctcatcttccatagcccacatggtaatgggtacaacaaatcaattctccacaagaacacggcttgaagaggtaaaaggattcttcagctctttgaaagaaaatggttctcagctccgttgtgtccaacagacaattgaaaccattgaagaaaacatcggttggatggataagaattttgataaaatcagagtgtggctgcaaagtgaaaagcttgaacgtatgtaaaaattcctcccttgccaggttcctgttatctctaatcaccaacattttgttgagtgtattttcaaactagagatggctgttttggctccaactggagatacttttttcccttcaactcattttttgactatccctgtgaaaagaatagctgttagtttttcatgaatgggctatcgctaccatgtgttttgttcatcacaggtgttgccctgcaacgtaaacccaagtgttgggttccctgccacagaagaataaagtaccttattcttctcattttatagtttatgcttaagcacccgtgtccaaaaccctgtaccccatgtttatcattcataaactgtttcatcagtctcctcgaaagactctgaatagtcgactactgaacaatgaacacctggatctgagactaagccggacgatgactgggttaaagctctcccggctcacccctccagacccgctgcccatccctcttccttgctccatgcccaggggctgacttgtaaaggccaagtcatcaagctttcttgccctttggatgttggtcagtggggagccggagagctggagctggggtcggaggaggtagtaggtggaggtgttcttccctgattcccttgcgggatgcctcgggctggcctcccctgagggtcttagctccgagaggggaccctcttttccacacagccttctccacctctggattttggtaactgctccctcctcatcccttcaggattagtggcctcagtgggagtctggcttttactagtcctggcggacttgtggtttctacataatgtgctcgcacttttgcaaaaaatctttttatagaaccctcctcagataattctgagtgtcatctatttccctgactggtacagtatctcttctgaaaaagcagagtgcattcaagtctgtaggaaaacccttttcttagggaggtgattttttttctctctctgcttcttatttggcctactttacaatttctaactaactagttattggcatttactgacagtaaattattgcagtcaccaataaatgatagtacattgtgaaacaaaatatttgctcatattagcaaataggacattctttggctttgaagtctttcttttgtgaagacttcacacacggttgcttcagcacacagttgctgctcaggttttatgtatagatgataataatagaaagcacagtttactaacatggtaaaccaacggagttcaagtcaagtcagttaataccctaagaattagattttatttcttattctgaaaacttgctacacagggacttatctaacccatagtgtgctctgttgctgacttgattcaagttgcagcgtgttttgcgctgactctaaggtgcggaaatcctcacacctggcaaaggagaattcaaactgaacttttgaatggtttaataaaaatagaaatcactggtaatttccaccccaaactaaactatttcccttcttttaaaaaaatacacaaccaagattttaatgtaaaatattttgctttaattgtattttatgccttgattaatgaaacatggaaatattgattttcagttttggtcacctgaggaacctatctttgtttgcttttggaaaagcccattttctaaacagatacaatattgccacaacaatgtgcagaaacctttttgataataaaaaattgttctttgcctctaa

SEQ ID NO: 935 - DNA, 6768 bp, Homo sapiens
tttaccaattcccttcctgggagttgcggcttccctcgctcggccccactcccgtttaccctttccccagctcccgccttagccaggggcttccccgcctgccgctagggctcgggccgaagcgccgctcagcgccagcctgccgctccccgggctccactttcactttcggtcctgggggagctaggccggcggcagtggtggtggcggcggcgcaagggtgagggcggccccagaaccccaggtaggtagagcaagaagatggtgtttctgcccctcaaatggtcccttgcaaccatgtcatttctactttcctcactgttggctctcttaactgtgtccactccttcatggtgtcagagcactgaagcatctccaaaacgtagtgatgggacaccatttccttggaataaaatacgacttcctgagtacgtcatcccagttcattatgatctcttgatccatgcaaaccttaccacgctgaccttctggggaaccacgaaagtagaaatcacagccagtcagcccaccagcaccatcatcctgcatagtcaccacctgcagatatctagggccaccctcaggaagggagctggagagaggctatcggaagaacccctgcaggtcctggaacacccccctcaggagcaaattgcactgctggctcccgagcccctccttgtcgggctcccgtacacagttgtcattcactatgctggcaatctttcggagactttccacggattttacaaaagcacctacagaaccaaggaaggggaactgaggatactagcatcaacacaatttgaacccactgcagctagaatggcctttccctgctttgatgaacctgccttcaaagcaagtttctcaatcaaaattagaagagagccaaggcacctagccatctccaatatgccattggtgaaatctgtgactgttgctgaaggactcatagaagaccattttgatgtcactgtgaagatgagcacctatctggtggccttcatcatttcagattttgagtctgtcagcaagataaccaagagtggagtcaaggtttctgtttatgctgtgccagacaagataaatcaagcagattatgcactggatgctgcggtgactcttctagaattttatgaggattatttcagcataccgtatcccctacccaaacaagatcttgctgctattcccgactttcagtctggtgctatggaaaactggggactgacaacatatagagaatctgctctgttgtttgatgcagaaaagtcttctgcatcaagtaagcttggcatcacaatgactgtggcccatgaactggcccaccagtggtttgggaacctggtcactatggaatggtggaatgatctttggctaaatgaaggatttgccaaatttatggagtttgtgtctgtcagtgtgacccatcctgaactgaaagttggagattatttctttggcaaatgttttgacgcaatggaggtagatgctttaaattcctcacaccctgtgtctacacctgtggaaaatcctgctcagatccgggagatgtttgatgatgtttcttatgataagggagcttgtattctgaatatgctaagggagtatcttagcgctgacgcatttaaaagtggtattgtacagtatctccagaagcatagctataaaaatacaaaaaacgaggacctgtgggatagtatggcaagtatttgccctacagatggtgtaaaagggatggatggcttttgctctagaagtcaacattcatcttcatcctcacattggcatcaggaaggggtggatgtgaaaaccatgatgaacacttggacactgcagaggggttttcccctaataaccatcacagtgagggggaggaatgtacacatgaagcaagagcactacatgaagggctctgacggcgccccggacactgggtacctgtggcatgttccattgacattcatcaccagcaaatccgacatggtccatcgatttttgctaaaaacaaaaacagatgtgctcatcctcccagaagaggtggaatggatcaaatttaatgtgggcatgaatggctattacattgtgcattacgaggatgatggatgggactctttgactggccttttaaaaggaacacacacagcagtcagcagtaatgatcgggcaagtctcattaacaatgcatttcagctcgtcagcattgggaagctgtccattgaaaaggccttggatttatccctgtacttgaaacatgaaactgaaattatgcccgtgtttcaaggtttgaatgagctgattcctatgtataagttaatggagaaaagagatatgaatgaagtggaaactcaattcaaggccttcctcatcaggctgctaagggacctcattgataagcagacatggacagacgagggctcagtctcagagcgaatgctgcggagtgaactactactcctcgcctgtgtgcacaactatcagccgtgcgtacagagggcagaaggctatttcagaaagtggaaggaatccaatggaaacttgagcctgcctgtcgacgtgaccttggcagtgtttgctgtgggggcccagagcacagaaggctgggattttctttatagtaaatatcagttttctttgtccagtactgagaaaagccaaattgaatttgccctctgcagaacccaaaataaggaaaagcttcaatggctactagatgaaagctttaagggagataaaataaaaactcaggagtttccacaaattcttacactcattggcaggaacccagtaggatacccactggcctggcaatttctgaggaaaaactggaacaaacttgtacaaaagtttgaacttggctcatcttccatagcccacatggtaatgggtacaacaaatcaattctccacaagaacacggcttgaagaggtaaaaggattcttcagctctttgaaagaaaatggttctcagctccgttgtgtccaacagacaattgaaaccattgaagaaaacatcggttggatggataagaattttgataaaatcagagtgtggctgcaaagtgaaaagcttgaacatgatcctgaagctgacgcaacaggatgaaaatccatcagaatctcagactacagcactaaatatgctttgatgctacatcaaacggaatggaagcatagctgacttcgctaaagttacttcatctccatctagcaaatgaggcactgttctcaaccaaaggagatggggatctggtttagggcaatccctttataatttgatgtgctgtggtctccttggtaatgtataatttggtattgcacaggtgattagtcaaggaagtctggaaaagctttggtcccacagccttgcctcacagcatgtaaataattaaaacaatattgatgctgaggttcttctactgctagtatgaaagtgacaaatttttactggtgtgaattgggaagaaaacaatgctattccatgacgtttgtaaaatgtttgtaaaagctcaaacatgacgattccataaaataaacttgaggttaaataatgggtagtaaattatagaatgtataagaaaaaatataaaggagaaaatcaattatcaggaaagctaaagaacttttcaaatctagtaatttgaatatagacacaatgcactttattgcactttcaattcttataaagcaacaataatattaaggtccttgactatgtgtacaatgttttcacatatatagtttcatttaatcatttcaaagttaatctctgccatctcgctaaatcatcagtcttggctcttctgaaatagaaggtgcctgatcttcctaataattctgcctattttcatttgctttaaacaggcgccctattttctttctagttgtggctgcgcaaaaacatttatctcccaaataagatgtgctgcttaccgaggtatcacggggtggggctccagcttgggtcgttgaagctggggtttgggaaaccacttcagagatggcagcagcaagtttagcatcttcaaatttcttttattgaaaaaaattttattagtaacatgttgtatataaaattatgagcacaatgccatcacttaactataactcttaacgatagcttaatgactgtttattctcttgaccaaatagactcataataacatataattttaaaagaaatttaaattctttcttctctattgtattattttatacaatttgctatttctatttccttctcatattgattattctaaatactatgcaataatataacttagagttccacggtttgtttacacatttcctgttgtacatttaggttattcaaagttttcagctcttttaaaattgctctgaataagttctagtgagtgagttatggtgctggctatattttgctaaactgccctctcaaatgttgctaggaattcatactgcgaaaagcaatgaataagcatgcctgttttcccatggccttgcttgccagaatttgacttttattatgataatcagtgtaaaatgatatactactattgcttgtatattgtggtatacggtgtcaggtttcagggttttttttcaacgttaaatattctagaaactttctgaaataatttctgtttaaaaatattgaatatttgcttcatttcaaatactcccttttgacaaaaaaacttaggtataactgttgatgaaaaaccagaaaaaagtccagaactctttggtgactccaactatggatagcttattttgaaaaaggagaattgcaaattttaccaaaagatggagaaaagcacattaaaaagataccaacattcagaaattcatttcagcatgttattattggaaattatttaaactaatttagataactataagatacttattgtccatttataccctgtaaagccgttttagaatgtaatattttaggtaatccaaaatgtactaaattaaattcatttttagttatgagaaatctttgcttatatgacaaatgaaaagaataacaagttgtcaaatgaaaagaatgacattgaaacatttgtattgtctcttcttaaactatcttattgacttattatttaagccttttaatactaagtatgaaacaacctatggtctggaaatttgtatcgcaaagctatatgtgcatatgttatttaattcatctaatgctacacaaaagcataaaataatgatttttcactctctttaaaaatactaaatcatttatgtccatttctcaattttttcattgatctatgctttgagtttgctttctcaacattattgtattttccacttattattactgtataacatatgctagtgtttagttggattaatcttacctaaaagtactgaaaaatgctttttagtactttttcatattttatacatttattttccgaatgtatcattgaataattttattgagttataaaagtatcttattgctatttaataaaaaattaacacataaaatgacttgaattgtcatcattctttttaagatatttagttaaactgacttaatgtatggccttcaatttttttgtgtccttatttttctgatcatttctccttttatagtttacattaagtctgatctcatattaattacattttctcatctgttgttactaataaacatggcataatgttacttacaaatgtattatctacaagtagtgctatccacaaatatattcaaatgttcccttttaatgtttgtcatttttttcatgtgttgttaatgattcttccatgtgataataagcagaaatgacaataaacttttcatagtttctgcttttaaggaaaatgcctccagcatgatattgaatatttgattctgaaaactaaagactctttaacagattaggggattgcctactttttaaaaagtttttatttataatatgagtatatgtaaaattttaaatagatcttttacatggacatgattatttgtttctatttgatataccactacaatatattgacagttttcctgctactgaatcaatacttataatggcaaataatttaactgtttgttatattctatgtatgctgtatgtaatttttacatctacacatttaagtaactttagctgataccgttatatttgtcagattttaagattagcaccataattactcatagaagcaactatgtgaccccatctttttcatgacatatttatgccacataagaactgagtgttcaacagttagagtcatctttaaaccttcagtagaaggacagtttgaaaatcattgcaatattttcttcagtctttttttaggttttgtgaattacgcagtttaatatttttgtttaatcttagaaaattgttgtacatagtgtttcctaataatttatttgtgctctgtactgattattgtattttctcacatttatgttaaattttattagtaagattattttctctatttatcagttttgtaaaatgttaaaaattcataaaagccaactgactattggctttaaactaccaataatttagttgatctctatattattatattactctgttaaaatttaattgtattttttgtaaggttttttttcctcttttatatttgctagtattttataaagtatttgttatttcaaaagaaacaactattggccagttaactttcatgccgctattttcatttcctggtatgcttattgctactttgtttttggtggctaccttattaaaacttttagaaatttcagttt

SEQ ID NO: 936 - DNA, 5923 bp, Homo sapiens
tttaccaattcccttcctgggagttgcggcttccctcgctcggccccactcccgtttaccctttccccagctcccgccttagccaggggcttccccgcctgccgctagggctcgggccgaagcgccgctcagcgccagcctgccgctccccgggctccactttcactttcggtcctgggggagctaggccggcggcagtggtggtggcggcggcgcaagggtgagggcggccccagaaccccaggtaggtagagcaagaagatggtgtttctgcccctcaaatggtcccttgcaaccatgtcatttctactttcctcactgttggctctcttaactgtgtccactccttcatggtgtcagagcactgaagcatctccaaaacgtagtgatgggacaccatttccttggaataaaatacgacttcctgagtacgtcatcccagttcattatgatctcttgatccatgcaaaccttaccacgctgaccttctggggaaccacgaaagtagaaatcacagccagtcagcccaccagcaccatcatcctgcatagtcaccacctgcagatatctagggccaccctcaggaagggagctggagagaggctatcggaagaacccctgcaggtcctggaacacccccctcaggagcaaattgcactgctggctcccgagcccctccttgtcgggctcccgtacacagttgtcattcactatgctggcaatctttcggagactttccacggattttacaaaagcacctacagaaccaaggaaggggaactgaggatactagcatcaacacaatttgaacccactgcagctagaatggcctttccctgctttgatgaacctgccttcaaagcaagtttctcaatcaaaattagaagagagccaaggcacctagccatctccaatatgccattggtgaaatctgtgactgttgctgaaggactcatagaagaccattttgatgtcactgtgaagatgagcacctatctggtggccttcatcatttcagattttgagtctgtcagcaagataaccaagagtggagtcaaggtttctgtttatgctgtgccagacaagataaatcaagcagattatgcactggatgctgcggtgactcttctagaattttatgaggattatttcagcataccgtatcccctacccaaacaagatcttgctgctattcccgactttcagtctggtgctatggaaaactggggactgacaacatatagagaatctgctctgttgtttgatgcagaaaagtcttctgcatcaagtaagcttggcatcacaatgactgtggcccatgaactggcccaccagtggtttgggaacctggtcactatggaatggtggaatgatctttggctaaatgaaggatttgccaaatttatggagtttgtgtctgtcagtgtgacccatcctgaactgaaagttggagattatttctttggcaaatgttttgacgcaatggaggtagatgctttaaattcctcacaccctgtgtctacacctgtggaaaatcctgctcagatccgggagatgtttgatgatgtttcttatgataagggagcttgtattctgaatatgctaagggagtatcttagcgctgacgcatttaaaagtggtattgtacagtatctccagaagcatagctataaaaatacaaaaaacgaggacctgtgggatagtatggcaagtatttgccctacagatggtgtaaaagggatggatggcttttgctctagaagtcaacattcatcttcatcctcacattggcatcaggaaggggtggatgtgaaaaccatgatgaacacttggacactgcagaggggttttcccctaataaccatcacagtgagggggaggaatgtacacatgaagcaagagcactacatgaagggctctgacggcgccccggacactgggtacctgtggcatgttccattgacattcatcaccagcaaatccgacatggtccatcgatttttgctaaaaacaaaaacagatgtgctcatcctcccagaagaggtggaatggatcaaatttaatgtgggcatgaatggctattacattgtgcattacgaggatgatggatgggactctttgactggccttttaaaaggaacacacacagcagtcagcagtaatgatcgggcaagtctcattaacaatgcatttcagctcgtcagcattgggaagctgtccattgaaaaggccttggatttatccctgtacttgaaacatgaaactgaaattatgcccgtgtttcaaggtttgaatgagctgattcctatgtataagttaatggagaaaagagatatgaatgaagtggaaactcaattcaaggccttcctcatcaggctgctaagggacctcattgataagcagacatggacagacgagggctcagtctcagagcgaatgctgcggagtgaactactactcctcgcctgtgtgcacaactatcagccgtgcgtacagagggcagaaggctatttcagaaagtggaaggaatccaatggaaacttgagcctgcctgtcgacgtgaccttggcagtgtttgctgtgggggcccagagcacagaaggctgggattttctttatagtaaatatcagttttctttgtccagtactgagaaaagccaaattgaatttgccctctgcagaacccaaaataaggaaaagcttcaatggctactagatgaaagctttaagggagataaaataaaaactcaggagtttccacaaattcttacactcattggcaggaacccagtaggatacccactggcctggcaatttctgaggaaaaactggaacaaacttgtacaaaagtttgaacttggctcatcttccatagcccacatggtaatgggtacaacaaatcaattctccacaagaacacggcttgaagaggtaaaaggattcttcagctctttgaaagaaaatggttctcagctccgttgtgtccaacagacaattgaaaccattgaagaaaacatcggttggatggataagaattttgataaaatcagagtgtggctgcaaagtgaaaagcttgaacgtatgtaaaaattcctcccttgccaggttcctgttatctctaatcaccaacattttgttgagtgtattttcaaactagagatggctgttttggctccaactggagatacttttttcccttcaactcattttttgactatccctgtgaaaagaatagctgttagtttttcatgaatgggctatcgctaccatgtgttttgttcatcacaggtgttgccctgcaacgtaaacccaagtgttgggttccctgccacagaagaataaagtaccttattcttctcattttatagtttatgcttaagcacccgtgtccaaaaccctgtaccccatgtttatcattcataaactgtttcatcagtctcctcgaaagactctgaatagtcgactactgaacaatgaacacctggatctgagactaagccggacgatgactgggttaaagctctcccggctcacccctccagacccgctgcccatccctcttccttgctccatgcccaggggctgacttgtaaaggccaagtcatcaagctttcttgccctttggatgttggtcagtggggagccggagagctggagctggggtcggaggaggtagtaggtggaggtgttcttccctgattcccttgcgggatgcctcgggctggcctcccctgagggtcttagctccgagaggggaccctcttttccacacagccttctccacctctggattttggtaactgctccctcctcatcccttcaggattagtggcctcagtgggagtctggcttttactagtcctggcggacttgtggtttctacataatgtgctcgcacttttgcaaaaaatctttttatagaaccctcctcagataattctgagtgtcatctatttccctgactggtacagtatctcttctgaaaaagcagagtgcattcaagtctgtaggaaaacccttttcttagggaggtgattttttttctctctctgcttcttatttggcctactttacaatttctaactaactagttattggcatttactgacagtaaattattgcagtcaccaataaatgatagtacattgtgaaacaaaatatttgctcatattagcaaataggacattctttggctttgaagtctttcttttgtgaagacttcacacacggttgcttcagcacacagttgctgctcaggttttatgtatagatgataataatagaaagcacagtttactaacatggtaaaccaacggagttcaagtcaagtcagttaataccctaagaattagattttatttcttattctgaaaacttgctacacagggacttatctaacccatagtgtgctctgttgctgacttgattcaagttgcagcgtgttttgcgctgactctaaggtgcggaaatcctcacacctggcaaaggagaattcaaactgaactttttgaatataaggcaaaaacttcaagataagggaatatgattgatgattggtacgaaaaatgtcaaaatgtgttcccctaatacacgacaaaatagagtgacttctggacataaatctgccatttattaaaccattcactacaacaaataaataggtataaaagtggaattggaatttttatacttatttgttgtagtgaatggtttaataaaaatagaaatcactggtaatttccaccccaaactaaactatttcccttcttttaaaaaaatacacaaccaagattttaatgtaaaatattttgctttaattgtattttatgccttgattaatgaaacatggaaatattgattttcagttttggtcacctgaggaacctatctttgtttgcttttggaaaagcccattttctaaacagatacaatattgccacaacaatgtgcagaaacctttttgataataaaaaattgttctttgcctctaagtggatatttgcaattattttctctctcctaactagactgtaaaaagggctgctttagatcctgtagcttactccagttattagttattaacaaacacccaagtctcgaagatatttctaattaaaaaagaaggcatattcagagttctttttaaataaatgttgtttacttttataggcatctttaaacttctggattttggtatgccatttaaaaatacttccagatacacatggaaattagtaatactgcagccgtatccttgcaaacacatctgtcagtgtcaaaggtttcaaggtttttcttaaaaaaagaaaacaaaaaagcaaacacctatactgcccaaatgggaggattagatacatggttagaaatccctcaggaaaagtgttttttcttttcttgttgctgccttaaaaatagaataatgactatttctgatggatagagacatagcattttaagctggtggtgtgtaaaatcccataggtatgtgcatgactttcagagagtatttgggggggaggttaacaagatgtggtgccatttataagcagtgttattgtttttgcttgccccgctgccacaagtcagctaagtcataacaaaagcttcaaactgatgctaaggaaggccatgccctttggaaacaataaattcccaatctgttttatgttatgtacctgacatcttttcctgcattctctaccaggaaataaagatgaaattaaatatcaaaattctaatcgatgatatcagtgcaatgttcaggaactattcattaagatattagaaaaccattcaaagtggtaggacatcagagcctacttcttacattgctgtgggagaaatgcaggtttcaaatttaatatatatatataatttttttaaaagcagaagtttctttttatatttggtaaacttaagttcc

SEQ ID NO: 937 - DNA, 5327 bp, Homo sapiens
actttcggtcctgggggagctaggccggcggcagtggtggtggcggcggcgcaagggtgagggcggccccagaaccccaggtaggtagagcaagaagatggtgtttctgcccctcaaatggtcccttgcaatcatgtcatttctactttcctcactgttggctctcttaactgtgtccactccttcatggtgtcagagcactgaagcatctccaaaacgtagtgatgggacaccatttccttggaataaaatacgacttcctgagtacgtcatcccagttcattatgatctcttgatccatgcaaaccttaccacgctgaccttctggggaaccacgaaagtagaaatcacagccagtcagcccaccagcaccatcatcctgcatagtcaccacctgcagatatctagggccaccctcaggaagggagctggagagaggctatcggaagaacccctgcaggtcctggaacacccccctcaggagcaaattgcactgctggctcccgagcccctccttgtcgggctcccgtacacagttgtcattcactatgctggcaatctttcggagactttccacggattttacaaaagcacctacagaaccaaggaaggggaactgaggatactagcatcaacacaatttgaacccactgcagctagaatggcctttccctgctttgatgaacctgccttcaaagcaagtttctcaatcaaaattagaagagagccaaggcacctagccatctccaatatgccattggtgaaatctgtgactgttgctgaaggactcatagaagaccattttgatgtcactgtgaagatgagcacctatctggtggccttcatcatttcagattttgagtctgtcagcaagataaccaagagtggagtcaaggtttctgtttatgctgtgccagacaagataaatcaagcagattatgcactggatgctgcggtgactcttctagaattttatgaggattatttcagcataccgtatcccctacccaaacaagatcttgctgctattcccgactttcagtctggtgctatggaaaactggggactgacaacatatagagaatctgctctgttgtttgatgcagaaaagtcttctgcatcaagtaagcttggcatcacagtgactgtggcccatgaactggcccaccagtggtttgggaacctggtcactatggaatggtggaatgatctttggctaaatgaaggatttgccaaatttatggagtttgtgtctgtcagtgtgacccatcctgaactgaaagttggagattatttctttggcaaatgttttgacgcaatggaggtagatgctttaaattcctcacaccctgtgtctacacctgtggaaaatcctgctcagatccgggagatgtttgatgatgtttcttatgataagggagcttgtattctgaatatgctaagggagtatcttagcgctgacgcatttaaaagtggtattgtacagtatctccagaagcatagctataaaaatacaaaaaacgaggacctgtgggatagtatggcaagtatttgccctacagatggtgtaaaagggatggatggcttttgctctagaagtcaacattcatcttcatcctcacattggcatcaggaaggggtggatgtgaaaaccatgatgaacacttggacactgcagaggggttttcccctaataaccatcacagtgagggggaggaatgtacacatgaagcaagagcactacatgaagggctctgacggcgccccggacactgggtacctgtggcatgttccattgacattcatcaccagcaaatccaacatggtccatcgatttttgctaaaaacaaaaacagatgtgctcatcctcccagaagaggtggaatggatcaaatttaatgtgggcatgaatggctattacattgtgcattacgaggatgatggatgggactctttgactggccttttaaaaggaacacacacagcagtcagcagtaatgatcgggcaagtctcattaacaatgcatttcagctcgtcagcattgggaagctgtccattgaaaaggccttggatttatccctgtacttgaaacatgaaactgaaattatgcccgtgtttcaaggtttgaatgagctgattcctatgtataagttaatggagaaaagagatatgaatgaagtggaaactcaattcaaggccttcctcatcaggctgctaagggacctcattgataagcagacatggacagacgagggctcagtctcagagcaaatgctgcggagtgaactactactcctcgcctgtgtgcacaactatcagccgtgcgtacagagggcagaaggctatttcagaaagtggaaggaatccaatggaaacttgagcctgcctgtcgacgtgaccttggcagtgtttgctgtgggggcccagagcacagaaggctgggattttctttatagtaaatatcagttttctttgtccagtactgagaaaagccaaattgaatttgccctctgcagaacccaaaataaggaaaagcttcaatggctactagatgaaagctttaagggagataaaataaaaactcaggagtttccacaaattcttacactcattggcaggaacccagtaggatacccactggcctggcaatttctgaggaaaaactggaacaaacttgtacaaaagtttgaacttggctcatcttccatagcccacatggtaatgggtacaacaaatcaattctccacaagaacacggcttgaagaggtaaaaggattcttcagctctttgaaagaaaatggttctcagctccgttgtgtccaacagacaattgaaaccattgaagaaaacatcggttggatggataagaattttgataaaatcagagtgtggctgcaaagtgaaaagcttgaacatgatcctgaagctgacgcaacaggatgaaaatccatcagaatctcagactacagcactaaatatgctttgatgctacatcaaacggaatggaagcatagctgacttcgctaaagttacttcatctccatctagcaaatgaggcactgttctcaaccaaaggagatggggatctggtttagggcaatccctttataatttgatgtgctgtggtctccttggtaatgtataatttggtattgcacaggtgattagtcaaggaagtctggaaaagctttggtcccacagccttgcctcacagcatgtaaataattaaaacaatattgatgctgaggttcttctactgctagtatgaaagtgacaaatttttactggtgtgaattgggaagaaaacaatgctattccatgacgtttgtaaaatgtttgtaaaagctcaaacatgacgattccataaaataaacttgaggttaaataatgggtagtaaattatagaatgtataagaaaaaatataaaggagaaaatcaattatcaggaaagctaaagaacttttcaaatctagtaatttgaatatagacacaatgcactttattgcactttcaattcttataaagcaacaataatattaaggtccttgactatgtgtacaatgttttcacatatatagtttcatttaatcatttcaaagttaatctctgccatctcgctaaatcatcagtctcggctcttctgaaatagaaggtgcctgatcttcctaataattctgcctattttcatttgctttaaacaggcgccctattttctttctagttgtggctgcgcaaaaacatttatctcccaaataagatgtgctgcttaccgaggtatcacggggtggggctccagcttgggtcgttgaagctggggtttgggaaaccacttcagagatggcagcagcaagtttagcatcttcaaatttcttttattgaaaaaaattttattagtaacatgttgtatataaaattatgagcacaatgccatcacttaactataactcttaaagatagcttaatgactgtttattctcttgaccaaatagactcataataacatataattttaaaagaaatttaaattctttcttctctattgtattattttatacaatttgctatttctatttccttctcatattgattattctaaatactatgcaataatataacttagagttccacggtttgtttacacatttcctgttgtacatttaggttattcaaagttttcagctcttttaaaattgctctgaataagttctagtgagtgagttatggtgctggctatattttgctaaactgccctctcaaatgttgctaggaattcatactgcgaaaagcaatgaataagcatgcctgttttcccatggccttgcttgccagaatttgacttttattatgataatcagtgtaaaatgatatactactattgcttgtatattgtggtatacggtgtcaggtttcagggttttttttcaacgttaaatattctagaaactttctgaaataatttctgtttaaaaatattgaatatttgcttcatttcaaatactcccttttgacaaaaaaacttaggtataactgttgatgaaaaaccagaaaaaagtccagaactctttggtgactccaactatggatagcttattttgaaaaaggagaattgcaaattttaccaaaagatggagaaaagcacattaaaaagataccaacattcagaaattcatttcagcatgttattattggaaattatttaaactaatttagataactataagatacttattgtccatttataccctgtaaagccgttttagaatgtaatattttaggtaatccaaaatgtactaaattaaattcatttttagttatgagaaatctttgcttatatgacaaatgaaaagaataacaagttgtcaaatgaaaagaatgacattgaaacatttgtattgtctcttcttaaactatcttattgacttattatttaagccttttaatactaagtatgaaacaacctatggtctggaaatttgtatcgcaaagctatatgtgcatatgttatttaattcatctaacgctacacaaaagcataaaataatgatttttcactctctttaaaaatactaaatcatttatgtccatttctcaattttttcattgatctatgctttgagtttgctttctcaacattattgtattttccacttattattactgtataacatatgctagtgtttagttggattaatcttacctaaaagtactgaaaaatgctttttagtactttttcatattttatacatttattttccgaatgtatcattgaataattttattgagttataaaagtatcttattgctatttaataaaaaattaacacat

SEQ ID NO: 938 - DNA, 1746 bp, Homo sapiens
ccctgacctatgatggacgtattctctagccaattactagacggtattctcagacgggccgcctccattgccaatgaaatcttccagcggggtcgcggtaggcgggccgtggaccctctggtataaggcggtcccgggggagtgaggagaaagggggggtcttggcggccggaggaggagtaggtgcgggtgaagatggcggcagccgaggccgcgaactgcatcatggagaattttgtagccaccttggctaatgggatgagcctccagccgcctcttgaagaagtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctggggtctggctttgtttcctgggggcaaaggaggtttggggttcctttcgcaggtactgcagtgccagcctcagcagtggggggaccggccttggcacctgctggtggctgccattctgtggatctgcgtctcccgtcccccgtctctaggcctcttgctccccttccttggttccttctcggggtccctgtcctccacagctgtctctcagggtctttgtccaactcttttcatc

SEQ ID NO: 939 - DNA, 1685 bp, Homo sapiens
ctatgatggacgtattctctagccaattactagacggtattctcagacgggccgcctccattgccaatgaaatcttccagcggggtcgcggtaggcgggccgtggaccctctggtataaggcggtcccgggggagtgaggagaaagggggggtcttggcggccggaggaggagtaggtgcgggtgaagatggcggcagccgaggccgcgaactgcatcatggaggtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctggggtctggctttgtttcctgggggcaaaggaggtttggggttcctttcgcaggtactgcagtgccagcctcagcagtggggggaccggccttggcacctgctggtggctgccattctgtggatctgcgtctcccgtcccccgtctctaggcctcttgctccccttccttggttccttctcggggtccctgtcctccacagctgtctctcagggtctttgtccaactcttttcatc

SEQ ID NO: 940 - DNA, 1316 bp, Homo sapiens
gtgggcagccgaggccgcgaactgcatcatggagaattttgtagccaccttggctaatgggatgagcctccagccgcctcttgaagaagtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgtgtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctggg

SEQ ID NO: 941 - DNA, 1568 bp, Homo sapiens
agagttggcaaacccctgacctatgatggacgtattctctagccaattactagacggtattctcagacgggccgcctccattgccaatgaaatcttccagcggggtcgtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctggggtctggctttgtttcctgggggcaaaggaggtttggggttcctttcgcaggtactgcagtgccagcctcagcagtggggggaccggccttggcacctgctggtggctgccattctgtggatctgcgtctcccgtcccccgtctctaggcctcttgctccccttccttggttccttctcggggtccctgtcctccacagctgtctctcagggtctttgtccaactcttttcatc

SEQ ID NO: 942 - DNA, 1515 bp, Homo sapiens
aattttgtagccaccttggctaatgggatgagcctccagccgcctcttgaagaagtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctggggtctggctttgtttcctgggggcaaaggaggtttggggttcctttcgcaggtactgcagtgccagcctcagcagtggggggaccggccttggcacctgctggtggctgccattctgtggatctgcgtctcccgtcccccgtctctaggcctcttgctccccttccttggttccttctcggggtccctgtcctccacagctgtctctcagggtctttgtccaactcttttcatc

SEQ ID NO: 943 - DNA, 1019 bp, Homo sapiens
atggcggccgccgaggtcgtgaactgcatcatggaggtgtcctgtggccaggcggaaagcagcgagaagccgaacgtcgagggcatgacgtccaaagattactactttgactcctacgcccacttcggcaactccatgtttcacaaccgccacctctttaaagacaaggtggtgctggatgtgggctcggacacaagcatcctctgcatgttcgccgccaaggccgggcccgcaaggtcatcggcatcgagtgttccagtagctctgattatgcggtgaagattgtcaaagccaacaagttagaccacttggtgaccatcaccaaggggaaggtggaggagatagagctcccggtggaaaaggtgaacatcatcatcagcaagtggatgggctaactgcctcttctacgagtccatgctcaacactgtgctctatgcccggacaagtggctggcgcccaatagcctcatcttcccagaacgggccacactgtatgtgacggccaccgaggaccggcagtacaaagactacaagatccactggtgggagaacgtttatggcttcgatatatcttgcatcaaagatgtggccatcaaggaaaccctagtggatgtggtggacctcaaacagctggttaccaacgcctgcctcataaaggaggtagacatctacaccgtcaaggtggaagacctgaccttcacctccccgttctgcctgcaagtgaagcagaatgactacgtgcacacccaggtggcctacttcaacatcgagtttacgcactgccacaagaggaccggagggaccggcttctccaccatacccgagtccctgtacacgcactggaagcagacggtgttctacatggaggactacctgaccttgaagacgggcgaggagatcttcggcaccatcggcatgcggcccaacgccaagaactgggaccgggacttcaccatcaacctagatttcaggggccatctgtgcgacctgtcctgctccacagactacaggatgtgctga

SEQ ID NO: 944 - DNA, 1316 bp, Homo sapiens; identical to SEQ ID NO: 940

SEQ ID NO: 945 - DNA, 6340 bp, Homo sapiens
gtggctgagaagaaggaggcctgagagcgacatgtccccggcggctcaggcggagcggcccgtggcgctgtttttctgagtccggggtggcctggcagccggccgaggacgagggtcggcgggggctgcccccgtggtggtggccgccatgctgggagcctgggcggttgagggaaccgctgtggcgctcctgcgactgctgctgctgctgctgccgccggcgatccggggacccgggctcggcgtggccggcgtggccggcgcggcgggggccgggctgcccgagagcgtcatttgggcggtcaacgcgggtggagaggcgcatgtggacgtgcacgggatccacttccgcaaggaccctttggaaggccgggtgggccgagcctcagactatggcatgaaactgccaatcctgcgttccaaccctgaggaccagatcctgtatcaaactgagcggtacaatgaggagacctttggctacgaagtgcccatcaaagaggagggggactacgtgctggtcttgaaatttgcagaggtctactttgcacagtcccagcaaaaggtatttgatgtacgattgaatggccacgtcgtggtgaaggacttggatatctttgatcgtgttgggcatagcacagctcacgatgaaattatacctatgagcatcagaaaggggaagctgagtgtccagggggaggtgtccaccttcacagggaaactctacattgagtttgtcaaggggtactatgacaatcccaaggtctgtgcactctacatcatggctgggacagtggatgatgtaccaaagcttcagcctcatccgggattggagaagaaagaagaggaagaagaagaagaagaatatgatgaagggtctaatctcaaaaaacagaccaataagaaccgggtgcagtcaggcccccgcacacccaacccctatgcctcggacaacagcagcctcatgtttcccatcctggtggccttcggagtcttcattccaaccctcttctgcctctgccggttgtgagaacaaatgactatcctgaacagggtggaggggtgtgggaaagaaaccagccatattggttttggtttctgtatttttcacaatgattaatgaacaaaaacaaagagaaaaaaacacacatcaattaaaggagacaaaaagaggcagagcgagtagagagcagccctcattcaccacctggtcccagacgtgcttcagtcctcgtcctctctttgtggctggctcccagccttctctttcctcttgaggatacttagggtaaactggatccttcctgctcaaggatcctcatttgtatacctagtggaaaggactctgaactcagaggagtcactgttcctttttttaggttagaaattaacagcagggaaatgccatcttattacctgagacgaccagcactgggagttaggtacggtctgaagttatgtctagataagacttcagacgtcctgggattgaaagaatgtgtgtgaaggggtagaatttgtgcggtaaagacttaaaaaaaaaagtagggagattaaaaaaaaagaaagaaaatgcttccttatctggaagcctttctggattaatccagtgatggtcccacctttagtgtttgagctttgtcattgcttgtctccctggcatgtgccagttatagactgtccagcatccaagacgtttcggttatgtcgggtcctcagatcgcctctgacttgttaccacaacaaatcattttgatttcagtgcctgttggggacttgatttcttctcagttttgtttgtttgtttgtttccttaatctggctcatttgaaatttcttctccctctcaaccatcccactaagttatagccaagaagggaaggagacacggggatttggggttctctgcttgaatgtcttctcctttaccacctcaccttgttggtacctccctccctggatctctgagccagcagccaggaggacctgacccagcagttctttactggcccctttgtagggccttgctgccagggggcagggatgctttccagcctgcagcaacagaacacttgaccttaaaagtctcttctggtctttggattagaaaaggcttatgttagcatagcttaagagcaacctcagagatttgagccctactaagtgactgaccactgtttagagtgtctggtatctgatgttcatttattcccatgttcttgtgtgtcacagttcagccagttttggtttatgcctagagctacttcaaggaactagactaattagctatataggcccagcgatgcttcttattgatcttaatagtatgcccctccttcccctgtcctttcatttctctatccaagtagcagtcaggttcttggtgtgatgggactgaaagaattccagtcagccagagccttggcagctctgaagctaaccttagcatctaagtgtcgatcttgaattccctgaaaaaatttctataggaaatgaagcttccctggtcccctcctttctggccattgtcatccatttcccagttagggcaacaatgaaggaggacccagccaagctagaaggaattttgtggatgggagacagcaggattagcttcagcttgggctggagcagtcaatataggatctcaggccaggcccgcttttctagaatgtgtttaattttgagtttgctttattagatatgttttttaagagctctgtatatttgaactgctccttatgtgacaaaataggtagctcttgggctcatgtcctgggttttggctctttaatgattactccaggccagcatttagtcgtttgagaattgtagcctgttgttttcgctgtgacttgggtctcagtgctagggtattgagtcaggcagctggagggttgtggcccgaggctgcagtcagaggtatacttcccatagtgcttcacacagctcccctgcttctaaaggataaggtactgtagccttggtcctggggaccacctgcctggggcagtggacatcctaactaaacaggcttctggcagtagctttggttcctatcccatcgaaattccccaaagccctgggccactgccattgggttagtcaagatgaaggaggaggactggctgcctccattttgccttgtttgttagtttgcctgggtctgtctgaggaaggagggggtcccgccttccacctcaacacatcccttcagtgactcagagtctcagaaggaaaccctgactcctggggccatttcctaatggtactgtaagccaagcagctttgcttctgcctctgtttccaagcccacccttttcccctgagctcagggttagggatgggcgctttcctctctggttgtgaacgaaaggaaggaacatctttctatggctaacaaaaactaaaggggaagtgaggaaacaggaagaagtatggtgggggctggggtagactcccctggagccaagcctatccagctaacaagagctccctggggctggtcacagctggctcatgatgctgaacttgaaagtttttttgtttttgtttttgttttgtggctcctccaagatataggtacatgaagtttaggttaaaggggtgggattctttatttttatttttgtattgtatgtgtcaagaattactctgttgttcaccttttgctttttgcactgtttgttctcttatctgtattttgagcttagtgctaggactgagaggctgcaccatagggaatgtatgggagatggtgaggggtgccagtgaggggtgcgtggaggagaggcctgggctcctctactggatctacactctgtcccaggtttttagatcccactgagcccagctgactgaaaacaaggacagtcagggtgaaacttcttttgccagaagtgtggcctgagttgaatttctgggaggatgacgcagatgtctgctgcagagctgggctgagagttctgcagtctagctctgacttaggtcaggggcctgttggtctctcattggacgtttttgggtctcactcatgcttactgaaacattgtgccaagaaactctgtgggatttgtgtcccttaaaccagactcacttttctgaaaaatctccattgttgaggagaggctgctcaatcgacaccccgagttctcatgactgggaagatagttttcttcaggtgtcaatggcgttagactcccaggaagactagccctgcccacagggccacctgttggtttgagagcgtgttcgtgttctcttgccctccctgcctaagagctactgggatcacgttagcgggcatttaggctttgatgagagggcacagtttgagttaggtttacctccccctttctgtgcctgggaactgtttggtccagctttagaactgtggttttgacttccttatctcttgggagaagcttctgttttaaggaatttctcttccttcttctcctgcctctagcctctcctggaaaggcctggatatggtttctaaaatctcagctgagaacttcagaaaacagcagcagtattttccttttcctagtgctaaaatccctttccctagaaattggctcaccttgggaaacccagggaaagaatcagcaggttctctgccctccctaggggttggggaaggacccaccccggtcagcacagtgccttttcctctcctgctctgagccagggtggggcattccctctagattcaggtttgggcaggggtcctatagtccctgccatggggctgcttccctgtcccttccctcccctttgctggcctactctggcataattcaagtgtcttcttgccttggggatccttagtggcatcaaatggcaacatggaatattgtcctccatgcccctccagaaggacctaggagagtaggtgagctttccaaagtgagagacgaatctttctttctttttttttttaaagggcaggatgggtatgctttgggctttctccttctgtggccccggaggaaggagagactgaggcaaggcaaagtgatagtacactgaagcagaaccggaaacacccaggaactgttcagaaatctcagaagaaatctgcttctcttcgatggaaagatataattaacgatcaaagagctctaagaaaattgcaaagaagccttaatgttcaagctttagaaagatcagagcaatttttctctttcagtccaaactaagactctctgtatttaaatctctctggggcaagagggctagatttcctcattttgttatgagactagattggtaccagtagatcagctgcctagcgagggcaggtttcttctttgcatctgtgtggcttgcttccagtctggcctgtcctttccagctgccttttgtctagcctgctatggggggccagattatcttgataagagcaggtgatttggggactagctgggttggcaggaaaagagcaggatggatctcttgggacaggttcccccaggagtataaacacaaggagccaggattgtgctggcagccaaggaaacagtagtgcctgtttgagttggcagagagggccttggcacctcttgcatccaggcagtcttgtgagatgggggcacatagcactggggaaagcagaactccattctcacctctattttgagcttcagtgctttatttcagtatgaggaaaaacaacaacaaactgaagtgcgctttccgtcctttcaaaggacaactgtcgggaagggagagccgagttgcgaggtaggaggggagcactggcagggagagacattcttgactcctctcttccctggtgtgttgtgatccagggaatgaaaagaaatttgaccctggattggttctctccttggacttaaggaatcttaccttttccttccacaaagttctcccaggcaaggaccagctgcccattctgagcccagggcagcctcttcaaccattattggtctaacctggcttgtcaggaaaccaagcccacccttccacattgggcctggctgctctattctgtaccaagtactggagaaaaagcatcaagttcttagcccttgtagcttctaccctagtttcccatcctctctctgtggaggccaaaccaactctttgccagcagccacaacatgcattgacagcggcacagtgagatataactgatgggctttgaacctggttggccggggaagctgtaggggtggatagagctggctttccttctgggctgtctccatctgaccctaccccttccatgtcccaccccactcccaccaaaaagtacaaaatcaggatgtttttcactgtccattgctttgtgttttaataaacaatttgcagtgac

SEQ ID NO: 946 - DNA, 6367 bp, Homo sapiens
cccgtggctgagaagaaggaggcctgagagcgacatgtccccggcggctcaggcggagcggcccgtggcgctgtttttctgagtccggggtggcctggcagccggccgaggacgagggtcggcgggggctgcccccgtggtggtggccgccatgctgggagcctgggcggttgagggaaccgctgtggcgctcctgcgactgctgctgctgctgctgccgccggcgatccggggacccgggctcggcgtggccggcgtggccggcgcggcgggggccgggctgcccgagagcgtcatttgggcggtcaacgcgggtggagaggcgcatgtggacgtgcacgggatccacttccgcaaggaccctttggaaggccgggtgggccgagcctcagactatggcatgaaactgccaatcctgcgttccaaccctgaggaccagatcctgtatcaaactgagcggtacaatgaggagacctttggctacgaagtgcccatcaaagaggagggggactacgtgctggtcttgaaatttgcagaggtctactttgcacagtcccagcaaaaggtatttgatgtacgattgaatggccacgtcgtggtgaaggacttggatatctttgatcgtgttgggcatagcacagctcacgatgaaattatacctatgagcatcagaaaggggaagctgagtgtccagggggaggtgtccaccttcacagggaaactctacattgagtttgtcaaggggtactatgacaatcccaaggtctgtgcactctacatcatggctgggacagtggatgatgtaccaaagcttcagcctcatccgggattggagaagaaagaagaggaagaagaagaagaagaatatgatgaagggtctaatctcaaaaaacagaccaataagaaccgggtgcagtcaggcccccgcacacccaacccctatgcctcggacaacagcagcctcatgtttcccatcctggtggccttcggagtcttcattccaaccctcttctgcctctgccggttgtgagaacaaatgactatcctgaacagggtggaggggtgtgggaaagaaaccagccatattggttttggtttctgtatttttcacaatgattaatgaacaaaaacaaagagaaaaaaacacacatcaattaaaggagacaaaaagaggcagagcgagtagagagcagccctcattcaccacctggtcccagacgtgcttcagtcctcgtcctctctttgtggctggctcccagccttctctttcctcttgaggatacttagggtaaactggatccttcctgctcaaggatcctcatttgtatacctagtggaaaggactctgaactcagaggagtcactgttcctttttttaggttagaaattaacagcagggaaatgccatcttattacctgagacgaccagcactgggagttaggtacggtctgaagttatgtctagataagacttcagacgtcctgggattgaaagaatgtgtgtgaaggggtagaatttgtgcggtaaagacttaaaaaaaaaagtagggagattaaaaaaaaagaaagaaaatgcttccttatctggaagcctttctggattaatccagtgatggtcccacctttagtgtttgagctttgtcattgcttgtctccctggcatgtgccagttatagactgtccagcatccaagacgtttcggttatgtcgggtcctcagatcgcctctgacttgttaccacaacaaatcattttgatttcagtgcctgttggggacttgatttcttctcagttttgtttgtttgtttgtttccttaatctggctcatttgaaatttcttctccctctcaaccatcccactaagttatagccaagaagggaaggagacacggggatttggggttctctgcttgaatgtcttctcctttaccacctcaccttgttggtacctccctccctggatctctgagccagcagccaggaggacctgacccagcagttctttactggcccctttgtagggccttgctgccagggggcagggatgctttccagcctgcagcaacagaacacttgaccttaaaagtctcttctggtctttggattagaaaaggcttatgttagcatagcttaagagcaacctcagagacttgagccctactaagtgactgaccactgtttagagtgtctggtatctgatgttcatttattcccatgttcttgtgtgtcacagttcagccagttttggtttatgcctagagctacttcaaggaactagactaattagctatataggcccagcgatgcttcttattgatcttaatagtatgcccctccttcccctgtcctttcatttctctatccaagtagcagtcaggttcttggtgtgatgggactgaaagaattccagtcagccagagccttggcagctctgaagctaaccttagcatctaagtgtcgatcttgaattccctgaaaaaatttctataggaaatgaagcttccctggtcccctcctttctggccattgtcatccatttcccagttagggcaacaatgaaggaggacccagccaagctagaaggaattttgtggatgggagacagcaggattagcttcagcttgggctggagcagtcaatataggatctcaggccaggcccgcttttctagaatgtgtttaattttgagtttgctttattagatatgttttttaagagctctgtatatttgaactgctccttatgtgacaaaataggtagctcttgggctcatgtcctgggttttggctctttaatgattactccaggccagcatttagtcgtttgagaattgtagcctgttgttttcgctgtgacttgggtctcagtgctagggtattgagtcaggcagctggagggttgtggcccgaggctgcagtcagaggtatacttcccatagtgcttcacacagctcccctgcttctaaaggataaggtactgtagccttggtcctggggaccacctgcctggggcagtggacatcctaactaaacaggcttctggcagtagctttggttcctatcccatcgaaattccccaaagccctgggccactgccattgggttagtcaagatgaaggaggaggactggctgcctccattttgccttgtttgttagtttgcctgggtctgtctgaggaaggagggggtcccgccttccacctcaacacatcccttcagtgactcagagtctcagaaggaaaccctgactcctggggccatttcctaatggtactgtaagccaagcagctttgcttctgcctctgtttccaagcccacccttttcccctgagctcagggttagggatgggcgctttcctctctggttgtgaacgaaaggaaggaacatctttctatggctaacaaaaactaaaggggaagtgaggaaacaggaagaagtatggtgggggctggggtagactcccctggagccaagcctatccagctaacaagagctccctggggctggtcacagctggctcatgatgctgaacttgaaagtttttttgtttttgtttttgttttgtggctcctccaagatataggtacatgaagtttaggttaaaggggtgggattctttatttttatttttgtattgtatgtgtcaagaattactctgttgttcaccttttgctttttgcactgtttgttctcttatctgtattttgagcttagtgctaggactgagaggctgcaccatagggaatgtatgggagatggtgaggggtgccagtgaggggtgcgtggaggagaggcctgggctcctctactggatctacactctgtcccaggtttttagatcccactgagcccagctgactgaaaacaaggacagtcagggtgaaacttcttttgccagaagtgtggcctgagttgaatttctgggaggatgacgcagatgtctgctgcagagctgggctgagagttctgcagtctagctctgacttaggtcaggggcctgttggtctctcattggacgtttttgggtctcactcatgcttactgaaacattgtgccaagaaactctgtgggatttgtgtcccttaaaccagactcacttttctgaaaaatctccattgttgaggagaggctgctcaatcgacaccccgagttctcatgactgggaagatagttttcttcaggtgtcaatggcgttagactcccaggaagactagccctgcccacagggccacctgttggtttgagagcgtgttcgtgttctcttgccctccctgcctaagagctactgggatcacgttagcgggcatttaggctttgatgagagggcacagtttgagttaggtttacctccccctttctgtgcctgggaactgtttggtccagctttagaactgtggttttgacttccttatctcttgggagaagcttctgttttaaggaatttctcttccttcttctcctgcctctagcctctcctggaaaggcctggatatggtttctaaaatctcagctgagaacttcagaaaacagcagcagtattttccttttcctagtgctaaaatccctttccctagaaattggctcaccttgggaaacccagggaaagaatcagcaggttctctgccctccctaggggttggggaaggacccaccccggtcagcacagtgccttttcctctcctgctctgagccagggtggggcattccctctagattcaggtttgggcaggggtcctatagtccctgccatggggctgcttccctgtcccttccctcccctttgctggcctactctggcataattcaagtgtcttcttgccttggggatccttagtggcatcaaatggcaacatggaatattgtcctccatgcccctccagaaggacctaggagagtaggtgagctttccaaagtgagagacgaatctttctttctttttttttttaaagggcaggatgggtatgctttgggctttctccttctgtggccccggaggaaggagagactgaggcaaggcaaagtgatagtacactgaagcagaaccggaaacacccaggaactgttcagaaatctcagaagaaatctgcttctcttcgatggaaagatataattaacgatcaaagagctctaagaaaattgcaaagaagccttaatgttcaagctttagaaagatcagagcaatttttctctttcagtccaaactaagactctctgtatttaaatctctctggggcaagagggctagatttcctcattttgttatgagactagattggtaccagtagatcagctgcctagcgagggcaggtttcttctttgcatctgtgtggcttgcttccagtctggcctgtcctttccagctgccttttgtctagcctgctatggggggccagattatcttgataagagcaggtgatttggggactagctgggttggcaggaaaagagcaggatggatctcttgggacaggttcccccaggagtataaacacaaggagccaggattgtgctggcagccaaggaaacagtagtgcctgtttgagttggcagagagggccttggcacctcttgcatccaggcagtcttgtgagatgggggcacatagcactggggaaagcagaactccattctcacctctattttgagcttcagtgctttatttcagtatgaggaaaaacaacaacaaactgaagtgcgctttccgtcctttcaaaggacaactgtcgggaagggagagccgagttgcgaggtaggaggggagcactggcagggagagacattcttgactcctctcttccctggtgtgttgtgatccagggaatgaaaagaaatttgaccctggattggttctctccttggacttaaggaatcttaccttttccttccacaaagttctcccaggcaaggaccagctgcccattctgagcccagggcagcctcttcaaccattattggtctaacctggcttgtcaggaaaccaagcccacccttccacattgggcctggctgctctattctgtaccaagtactggagaaaaagcatcaagttcttagcccttgtagcttctaccctagtttcccatcctctctctgtggaggccaaaccaactctttgccagcagccacaacatgcattgacagcggcacagtgagatataactgatgggctttgaacctggttggccggggaagctgtaggggtggatagagctggctttccttctgggctgtctccatctgaccctaccccttccatgtcccaccccactcccaccaaaaagtacaaaatcaggatgtttttcactgtccattgctttgtgttttaataaacaatttgcagtgacactctgaaaaaaaaaaaaaaaaaa

SEQ ID NO: 947 - DNA, 1800 bp, Homo sapiens
gtggctgagaagaaggaggcctgagagcgacatgtccccggcggctcaggcggagcggcccgtggcgctgtttttctgagtccggggtggcctggcagccggccgaggacgagggtcggcgggggctgcccccgtggtggtggccgccatgctgggagcctgggcggttgagggaaccgctgtggcgctcctgcgactgctgctgctgctgctgccgccggcgatccggggacccgggctcggcgtggccggcgtggccggcgcggcgggggccgggctgcccgagagcgtcatttgggcggtcaacgcgggtggagaggcgcatgtggacgtgcacgggatccacttccgcaaggaccctttggaaggccgggtgggccgagcctcagactatggcatgaaactgccaatcctgcgttccaaccctgaggaccagatcctgtatcaaactgagcggtacaatgaggagacctttggctacgaagtgcccatcaaagaggagggggactacgtgctggtcttgaaatttgcagaggtctactttgcacagtcccagcaaaaggtatttgatgtacgattgaatggccacgtcgtggtgaaggacttggatatctttgatcgtgttgggcatagcacagctcacgatgaaattatacctatgagcatcagaaaggggaagctgagtgtccagggggaggtgtccaccttcacagggaaactctacattgagtttgtcaaggggtactatgacaatcccaaggtctgtgcactctacatcatggctgggacagtggatgatgtaccaaagcttcagcctcatccgggattggagaagaaagaagaggaagaagaagaagaagaatatgatgaagggtctaatctcaaaaaacagaccaataagaaccgggtgcagtcaggcccccgcacacccaacccctatgcctcggacaacagcagcctcatgtttcccatcctggtggccttcggagtcttcattccaaccctcttctgcctctgccggttggcaggatgggtatgctttgggctttctccttctgtggccccggaggaaggagagactgaggcaaggcaaagtgatagtacactgaagcagaaccggaaacacccaggaactgttcagaaatctcagaagaaatctgcttctcttcgatggaaagatataattaacgatcaaagagctttttctctttcagtccaaactaagactctctgtatttaaatctctctggggcaagagggctagatttcctcattttgttatgagactagattggtaccagtagatcagctgcctagcgagggcaggtttcttctttgcatctgtgtggcttgcttccagtctggcctgtcctttccagctgccttttgtctagcctgctatggggggccagattatcttgataagagcaggtgatttggggactagctgggttggcaggaaaagagcaggatggatctcttgggacaggttcccccaggagtataaacacaaggagccaggattgtgctgtctattttgagcttcagtgctttatttcagtatgaggaaaaacaacaacaaactgaagtgcgctttccgtcctttcaaaggacaactgtcgggaagggagagccgagttgcgaggtaggaggggagcactggcagggagagacattcttgactcctctcttccctggtgtgttgtgatccagggcaggcaaggaccagctgcccattctgagcccagggcagcctcttcaaccattattggtctaacctggcttgtcaggaaaccaagc

SEQ ID NO: 948 - DNA, 2590 bp, Homo sapiens
gccttatatagggcgacttggggcacgcagtagctctctcgagtcactccggcgcagtgttgggactgtctgggtatcggaaagcaagcctacgttgctcactattacgtataatccttttcttttcaagatgcctgaggaagtgcaccatggagaggaggaggtggagacttttgcctttcaggcagaaattgcccaactcatgtccctcatcatcaataccttctattccaacaaggagattttccttcgggagttgatctctaatgcttctgatgccttggacaagattcgctatgagagcctgacagacccttcgaagttggacagtggtaaagagctgaaaattgacatcatccccaaccctcaggaacgtaccctgactttggtagacacaggcattggcatgaccaaagctgatctcataaataatttgggaaccattgccaagtctggtactaaagcattcatggaggctcttcaggctggtgcagacatctccatgattgggcagtttggtgttggcttttattctgcctacttggtggcagagaaagtggttgtgatcacaaagcacaacgatgatgaacagtatgcttgggagtcttctgctggaggttccttcactgtgcgtgctgaccatggtgagcccattggcaggggtaccaaagtgatcctccatcttaaagaagatcagacagagtacctagaagagaggcgggtcaaagaagtagtgaagaagcattctcagttcataggctatcccatcaccctttatttggagaaggaacgagagaaggaaattagtgatgatgaggcagaggaagagaaaggtgagaaagaagaggaagataaagatgatgaagaaaaacccaagatcgaagatgtgggttcagatgaggaggatgacagcggtaaggataagaagaagaaaactaagaagatcaaagagaaatacattgatcaggaagaactaaacaagaccaagcctatttggaccagaaaccctgatgacatcacccaagaggagtatggagaattctacaagagcctcactaatgactgggaagaccacttggcagtcaagcacttttctgtagaaggtcagttggaattcagggcattgctatttattcctcgtcgggctccctttgacctttttgagaacaagaagaaaaagaacaacatcaaactctatgtccgccgtgtgttcatcatggacagctgtgatgagttgataccagagtatctcaattttatccgtggtgtggttgactctgaggatctgcccctgaacatctcccgagaaatgctccagcagagcaaaatcttgaaagtcattcgcaaaaacattgttaagaagtgccttgagctcttctctgagctggcagaagacaaggagaattacaagaaattctatgaggcattctctaaaaatctcaagcttggaatccacgaagactccactaaccgccgccgcctgtctgagctgctgcgctatcatacctcccagtctggagatgagatgacatctctgtcagagtatgtttctcgcatgaaggagacacagaagtccatctattacatcactggtgagagcaaagagcaggtggccaactcagcttttgtggagcgagtgcggaaacggggcttcgaggtggtatatatgaccgagcccattgacgagtactgtgtgcagcagctcaaggaatttgatgggaagagcctggtctcagttaccaaggagggtctggagctgcctgaggatgaggaggagaagaagaagatggaagagagcaaggcaaagtttgagaacctctgcaagctcatgaaagaaatcttagataagaaggttgagaaggtgacaatctccaatagacttgtgtcttcaccttgctgcattgtgaccagcacctacggctggacagccaatatggagcggatcatgaaagcccaggcacttcgggacaactccaccatgggctatatgatggccaaaaagcacctggagatcaaccctgaccaccccattgtggagacgctgcggcagaaggctgaggccgacaagaatgataaggcagttaaggacctggtggtgctgctgtttgaaaccgccctgctatcttctggcttttcccttgaggatccccagacccactccaaccgcatctatcgcatgatcaagctaggtctaggtattgatgaagatgaagtggcagcagaggaacccaatgctgcagttcctgatgagatcccccctctcgagggcgatgaggatgcgtctcgcatggaagaagtcgattaggttaggagttcatagttggaaaacttgtgcccttgtatagtgtccccatgggctcccactgcagcctcgagtgcccctgtcccacctggctccccctgctggtgtctagtgtttttttccctctcctgtccttgtgttgaaggcagtaaactaagggtgtcaagccccattccctctctactcttgacagcaggattggatgttgtgtattgtggtttattttattttcttcattttgttctgaaattaaagtatgcaaaataaagaatatgccgtttttataca

SEQ ID NO: 949 - DNA, 2587 bp, Homo sapiens
ggggaggggggagggatagcattaggagatatacctaatgctaaatgacgagttaatgggtgcagcacaccaacatggcacatgtatacatatgtaacaaacctgcacattgtgcacatgtaccctaaaacttaaagtataataataataataataactaaaaaataaaaataaaataaaaaataaaaaaaaagaaaaatacactccaggtatttcacataaaaagggagatagatgctaacaaaatccttagaagagacgaggaggaaagaactagagagagctccctccagctctcagattctccccagcttttggaggacctggaagttgaaaaagtcacagaacggctctggagtcactccggcacagcgtttgtgctgcctgtgtgttggagagccagcctaccttgctctttaatacgtgtaagccttttcttttcaagatgcctgaggaagtgcaccttggagagaaggaggtggagacttttgcctttcaggcagaaattgcccaactcatgtctcttatcatcaataccttctattccaacaaggagattttcctttgggagttgatctctaatgcttctgatgccttggacaagattcgctatgaaagcctaacagacccttccaagttggacagtggtaaagagctgaaaattgacatcatccccaatactcaggaacataccctgactttggtagacacaggcattggcatgaccaaagctgatctcataaataatttgggaaccattgccaagtttcgtacgaaagcattcatggaggctttttaggctggcgcagacatctccatgattgggcaatttggtattggcttttattctgcctacctggtagcagagaaagtggttgtgatcacaaagcccaatgatgatggcatgcctgagagtcttctgctggaggttccttcactgtgtgtgctgaccatggtgagcctattggtaggggtaccaaagtgatcctccaccttaaagaagatcagacagagtacttagaagagatgcaggtcaaagaagtagtggagaagcactctcagttcctaggctatcccatcaccctttatctggagaaggaacgagagaaagaaattagtgatggtaaggcagaggaagagaaaggtgagaaagaagaggaaaataaagatgacgaagaaaagcccaagatcgaagatgtgggttcagatgaggaggatgacagtggtaaggataagaagaagaaaactaagaagatcaaagagaaatacattgatcaggaagaactaaacaagaccaagcctatttggaccagaaacactgaagacatcacccaagaggagtatggagaattctataagagcctcaccaatgactggaaagaccacttggcagtcaggtacttttctgtagaaggtcagttggaattcagggcattgctattcattcctccttaggctccctttcatctttttgagaacaagaagaaaaagaacaacatcaaactctatgtccatcgtgtgttcatcagggacagctgtgttgagttgataccagagtgtctcaactttatccgtggtgtggttgactctgaggatttcccctgaacatctcctgagaaatgctccagcagagcaaaatcttcaaagtcattcacagaaacattgttaagaagtgccttgagctcttcactgagctggtggaagacaaggagaattacaagaaattctatgaggcattctctaaaaatctcaagcttggaatccacaaggactccactaactgatgccacccgtctgagctgctgtgttatcacacctcccagtctggagatgagatgatatctttgttagagtatgtttctcgcatgaaggagatacagaagtccatctattacatcactggtgagagcaaagagcaggttgccaactcagcttttgtggagcaagtatggaagcgggactccagggtggtatatatgaccgagcccattgatggctacgtgtgcagcaactcaaggagtttgatgggaagagcctggtctcagttaccaaggagggcctggagctacctgaggatggggaggagaagaagagaatggaagagaggaaggcaaagtttgagaacctctgcaagttcatgaaagaaactttagataagaaggttgagatggtgacagtctccaacaggcttgtgtcttcatcctgctgcattgtgaccagcacctacagctggacagccaatatggagcagatcatgaaagcctaggcacttcgggtcacctccaccgtgggctatatgatggccaaaaagcacctggagatcaaccccaaccaccccattgtggagacgctgcggcagaaggctgagacacacaagaatgacaaggcagtcaaggacctggtggtgctgccgttagaaactgccttgctgtcttctggcttttcccttgaggatccccagacccattccaaccacatctactgcatgatcaagctaggtctaggtatcgatgaagattaagtgacagcagaggaacacagtgctgtggttcctgatgagatcacccctcttgagggtgacgaggat

SEQ ID NO: 950 - DNA, 2589 bp, Homo sapiens
cgcccgcagagccgccccaggtgcctgggtgttgtgtgattgacgcggggaaggaggggtcagccgatccctccccaaccctccatcccatccctgaggattgggctggtacccgcgtctctcggacagatgcctgaggaagtgcaccatggagaggaggaggtggagacttttgcctttcaggcagaaattgcccaactcatgtccctcatcatcaataccttctattccaacaaggagattttccttcgggagttgatctctaatgcttctgatgccttggacaagattcgctatgagagcctgacagacccttcgaagttggacagtggtaaagagctgaaaattgacatcatccccaaccctcaggaacgtaccctgactttggtagacacaggcattggcatgaccaaagctgatctcataaataatttgggaaccattgccaagtctggtactaaagcattcatggaggctcttcaggctggtgcagacatctccatgattgggcagtttggtgttggcttttattctgcctacttggtggcagagaaagtggttgtgatcacaaagcacaacgatgatgaacagtatgcttgggagtcttctgctggaggttccttcactgtgcgtgctgaccatggtgagcccattggcaggggtaccaaagtgatcctccatcttaaagaagatcagacagagtacctagaagagaggcgggtcaaagaagtagtgaagaagcattctcagttcataggctatcccatcaccctttatttggagaaggaacgagagaaggaaattagtgatgatgaggcagaggaagagaaaggtgagaaagaagaggaagataaagatgatgaagaaaaacccaagatcgaagatgtgggttcagatgaggaggatgacagcggtaaggataagaagaagaaaactaagaagatcaaagagaaatacattgatcaggaagaactaaacaagaccaagcctatttggaccagaaaccctgatgacatcacccaagaggagtatggagaattctacaagagcctcactaatgactgggaagaccacttggcagtcaagcacttttctgtagaaggtcagttggaattcagggcattgctatttattcctcgtcgggctccctttgacctttttgagaacaagaagaaaaagaacaacatcaaactctatgtccgccgtgtgttcatcatggacagctgtgatgagttgataccagagtatctcaattttatccgtggtgtggttgactctgaggatctgcccctgaacatctcccgagaaatgctccagcagagcaaaatcttgaaagtcattcgcaaaaacattgttaagaagtgccttgagctcttctctgagctggcagaagacaaggagaattacaagaaattctatgaggcattctctaaaaatctcaagcttggaatccacgaagactccactaaccgccgccgcctgtctgagctgctgcgctatcatacctcccagtctggagatgagatgacatctctgtcagagtatgtttctcgcatgaaggagacacagaagtccatctattacatcactggtgagagcaaagagcaggtggccaactcagcttttgtggagcgagtgcggaaacggggcttcgaggtggtatatatgaccgagcccattgacgagtactgtgtgcagcagctcaaggaatttgatgggaagagcctggtctcagttaccaaggagggtctggagctgcctgaggatgaggaggagaagaagaagatggaagagagcaaggcaaagtttgagaacctctgcaagctcatgaaagaaatcttagataagaaggttgagaaggtgacaatctccaatagacttgtgtcttcaccttgctgcattgtgaccagcacctacggctggacagccaatatggagcggatcatgaaagcccaggcacttcgggacaactccaccatgggctatatgatggccaaaaagcacctggagatcaaccctgaccaccccattgtggagacgctgcggcagaaggctgaggccgacaagaatgataaggcagttaaggacctggtggtgctgctgtttgaaaccgccctgctatcttctggcttttcccttgaggatccccagacccactccaaccgcatctatcgcatgatcaagctaggtctaggtattgatgaagatgaagtggcagcagaggaacccaatgctgcagttcctgatgagatcccccctctcgagggcgatgaggatgcgtctcgcatggaagaagtcgattaggttaggagttcatagttggaaaacttgtgcccttgtatagtgtccccatgggctcccactgcagcctcgagtgcccctgtcccacctggctccccctgctggtgtctagtgtttttttccctctcctgtccttgtgttgaaggcagtaaactaagggtgtcaagccccattccctctctactcttgacagcaggattggatgttgtgtattgtggtttattttattttcttcattttgttctgaaattaaagtatgcaaaataaagaatatgccgtttttataca

SEQ ID NO: 951 - DNA, 2556 bp, Homo sapiens
gcgcagtgttgggactgtctgggtatcggaaagcaagcctacgttgctcactattacgtataatccttttcttttcaagatgcctgaggaagtgcaccatggagaggaggaggtggagacttttgcctttcaggcagaaattgcccaactcatgtccctcatcatcaataccttctattccaacaaggagattttccttcgggagttgatctctaatgcttctgatgccttggacaagattcgctatgagagcctgacagacccttcgaagttggacagtggtaaagagctgaaaattgacatcatccccaaccctcaggaacgtaccctgactttggtagacacaggcattggcatgaccaaagctgatctcataaataatttgggaaccattgccaagtctggtactaaagcattcatggaggctcttcaggctggtgcagacatctccatgattgggcagtttggtgttggcttttattctgcctacttggtggcagagaaagtggttgtgatcacaaagcacaacgatgatgaacagtatgcttgggagtcttctgctggaggttccttcactgtgcgtgctgaccatggtgagcccattggcaggggtaccaaagtgatcctccatcttaaagaagatcagacagagtacctagaagagaggcgggtcaaagaagtagtgaagaagcattctcagttcataggctatcccatcaccctttatttggagaaggaacgagagaaggaaattagtgatgatgaggcagaggaagagaaaggtgagaaagaagaggaagataaagatgatgaagaaaagcccaagatcgaagatgtgggttcagatgaggaggatgacagcggtaaggataagaagaagaaaactaagaagatcaaagagaaatacattgatcaggaagaactaaacaagaccaagcctatttggaccagaaaccctgatgacatcacccaagaggagtatggagaattctacaagagcctcactaatgactgggaagaccacttggcagtcaagcacttttctgtagaaggtcagttggaattcagggcattgctatttattcctcgtcgggctccctttgacctttttgagaacaagaagaaaaagaacaacatcaaactctatgtccgccgtgtgttcatcatggacagctgtgatgagttgataccagagtatctcaattttatccgtggtgtggttgactctgaggatctgcccctgaacatctcccgagaaatgctccagcagagcaaaatcttgaaagtcattcgcaaaaacattgttaagaagtgccttgagctcttctctgagctggcagaagacaaggagaattacaagaaattctatgaggcattctctaaaaatctcaagcttggaatccacgaagactccactaaccgccgccgcctgtctgagctgctgcgctatcatacctcccagtctggagatgagatgacatctctgtcagagtatgtttctcgcatgaaggagacacagaagtccatctattacatcactggtgagagcaaagagcaggtggccaactcagcttttgtggagcgagtgcggaaacggggcttcgaggtggtatatatgaccgagcccattgacgagtactgtgtgcagcagctcaaggaatttgatgggaagagcctggtctcagttaccaaggagggtctggagctgcctgaggatgaggaggagaagaagaagatggaagagagcaaggcaaagtttgagaacctctgcaagctcatgaaagaaatcttagataagaaggttgagaaggtgacaatctccaatagacttgtgtcttcaccttgctgcattgtgaccagcacctacggctggacagccaatatggagcggatcatgaaagcccaggcacttcgggacaactccaccatgggctatatgatggccaaaaagcacctggagatcaaccctgaccaccccattgtggagacgctgcggcagaaggctgaggccgacaagaatgataaggcagttaaggacctggtggtgctgctgtttgaaaccgccctgctatcttctggcttttcccttgaggatccccagacccactccaaccgcatctatcgcatgatcaagctaggtctaggtattgatgaagatgaagtggcagcagaggaacccaatgctgcagttcctgatgagatcccccctctcgagggcgatgaggatgcgtctcgcatggaagaagtcgattaggttaggagttcatagttggaaaacttgtgcccttgtatagtgtccccatgggctcccactgcagcctcgagtgcccctgtcccacctggctccccctgctggtgtctagtgtttttttccctctcctgtccttgtgttgaaggcagtaaactaagggtgtcaagccccattccctctctactcttgacagcaggattggatgttgtgtattgtggtttattttattttcttcattttgttctgaaattaaagtatgcaaaataaagaatatgccgtttttatacaaaaaaaaaaaaaaaaaa

SEQ ID NO: 952 - DNA, 657 bp, Homo sapiens
ttttctggtgagagcaaagagcaggtggccaattctgcttttgtggaccgagtgtggaagcggggcttcaaggtagtctctatgactgagtccattgatgagtaatgtgtgcagcagctcaaggaatttgatgggaaaagcctggtctcagttaccaaggagagtctggagctacctgagaatgaggagaagaaaatggaagagagcaaggcaaagtttgagaacctctgcaagctcatgaaaaaaaatcttagataaaaagtttgagaagatgacaatcttcaataggcttgtgtcttcaccctgttgcattgtgaccagcacctatggctggacagccaatatggagcagatcatgaaagcccaggcacttcgggacaactctaccatgggctacatgatggccaaaaagcacctggagatcaaccccaaccaccccattgtggagatgctgcagcagaaggctgaggctgataggaacagcaaggcagtcagggacctgatggtgctgctgtttgaaaccgtgctgctctcttctggcttcttccttgaggatccccaaactcactccaactagattgactgcaggatcaagctaggcctgttgaggatgaagtggaagcagaggaacccagtgctgcagttcctgatgagatt

SEQ ID NO: 953 - DNA, 448 bp, Homo sapiens
tctgccctctctggtcaccctgcctagctagaggatctgtgaccccagccatgaggaccctcgccatccttgctgccattctcctggtggccctgcaggcccaggctgagccactccaggcaagagctgatgaggttgctgcagccccggagcagattgcagcggacatcccagaagtggttgtttcccttgcatgggacgaaagcttggctccaaagcatccaggctcaaggaaaaacatggcctgctattgcagaataccagcgtgcattgcaggagaacgtcgctatggaacctgcatctaccagggaagactctgggcattctgctgctgagcttgcagaaaaagaaaaatgagctcaaaatttgctttgagagctacagggaattgctattactcctgtaccttctgctcaatttcctttcctcatcccaaataaatgccttg

SEQ ID NO: 954 - DNA, 487 bp, Homo sapiens
ccttgctatagaagacctgggacagaggactgctgtctgccctctctggtcaccctgcctagctagaggatctgtgaccccagccatgaggaccctcgccatccttgctgccattctcctggtggccctgcaggcccaggctgagccactccaggcaagagctgatgaggttgctgcagccccggagcagattgcagcggacatcccagaagtggttgtttcccttgcatgggacgaaagcttggctccaaagcatccaggctcaaggaaaaacatggactgctattgcagaataccagcgtgcattgcaggagaacgtcgctatggaacctgcatctaccagggaagactctgggcattctgctgctgagcttgcagaaaaagaaaaatgagctcaaaatttgctttgagagctacagggaattgctattactcctgtaccttctgctcaatttcctttcctcatctcaaataaatgccttgttac

SEQ ID NO: 955 - DNA, 5463 bp, Homo sapiens
gcggccgctgcaggtccccgctcccctccccgtgcgtccgcccatggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgggcagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttttttgacatgaacatctttgaagatgggccttatgaagttggtggagagactgagcatgatgaaagtctcgttcctgttcctgctaacagttacttaggcctgctgtttttgaccagcgtttcctatacagatcctgatcagtttgtttataaaacacggcctccccgggagcagcctgacacattccctgatgtgatgatgaatagctacctaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccagatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttatttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagagcatgggaggtcatcactttgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgttttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgttcattgtttcgtaacacagcattgtatatgtgaagcaaactctaaaattataaatgacaacctgaattatctatttcatcaaacc

SEQ ID NO: 956 - DNA, 5476 bp, Homo sapiens
gcggccgctgcaggtccccgctcccctccccgtgcgtccgcccatggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgggcagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttttttgacatgaacatctttgaagatgggccttatgaagttggtggagagactgagcatgatgaaagtctcgttcctgttcctgctaacagttacttaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccagatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggtttcttcaagagaaataagaaagatcattatgatgccacatatcacaaggctgagatccatgctcagccatctgataaagagaggcttacttctgatgcatagtattgatctacttctgtaattgtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttatttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagagcatgggaggtcatcactttgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgttttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgttcattgtttcgtaacacagcattgtatatgtgaagcaaactctaaaattataaatgacaacctgaattatctatttcatcaaacc

SEQ ID NO: 957 - DNA, 5346 bp, Homo sapiens
gcggccgctgcaggtccccgctcccctccccgtgcgtccgcccatggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgggcagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttttttgacatgaacatctttgaagatgggccttatgaagttggtggagagactgagcatgatgaaagtctcgttcctgttcctgctaacagttacttaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccagatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttatttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagagcatgggaggtcatcactttgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgttttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgttcattgtttcgtaacacagcattgtatatgtgaagcaaactctaaaattataaatgacaacctgaattatctatttcatcaaacc

SEQ ID NO: 958 - DNA, 5611 bp, Homo sapiens
gcgcgaccgtcccgggggtggggccgggcgcagcggcgagaggaggcgaaggtggctgcggtagcagcagcgcggcagcctcggacccagcccggagcgcagggcggccgctgcaggtccccgctcccctccccgtgcgtccgcccatggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgcggagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttttttgacatgaacatctttgaagatgggccttatgaagttggtggagagactgagcatgatgaaagtctcgttcctgttcctgctaacagttacttaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccatatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggtttcttcaagagaaataagaaagatcattatgatgccacatatcacaaggctgagatccatgctcagccatctgataaagagaggcttacttctgatgcatagtattgatctacttctgtaattgtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacagaaatgaaagctactcatagcgggggcctaaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttgtttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagaattagagcatgggagggtcatcactatgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttacatactgtaacattcaggaattcttggagaagatgggtttattcactgaactctagtgcggtttactcactgctgcaaatactgtatattcaggacttgaaagaaatggtgaatgcctatggaactagtggatccaaactgatccagtataagactactgaatctgctaccaaaacagttaatcagtgagtcgagtgttctattttttgttttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttggggggggctttttttctttttccggaaaatccttaaaccttaagatactaaggacgttgttttggttgtacttggaattcttagtcacaaaatatattttgtttacaaaaatttctgtaaaacaggttataacagtgtttaaagtctcagtttcttgcttggggaacttgtgtccctaatgtgttagattgctagattgctaaggagctgatacttgacagttttttagacctgtgttactaaaaaaaagatgaatgtcggaaaagggtgttgggagggtggtcaacaaagaaacaaagatgttatggtgtttagacttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgttcattgtttcgtaacacagcattgtatatgtgaagcaaactctaaaattataaatgacaacctgaattatctatttcatcaaaaaaaaaaaaaaaaaaaa

SEQ ID NO: 959 - DNA, 5778 bp, Homo sapiens
gccctcggacagtccctgctcgcccgcgcgctgcagccccatctcctagcggcagcccaggcgcggagggagcgagtccgccccgaggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgccgagggactactccaccctcacctccgtctcctcccacggcctccctcccatctgggaacacgggaggagcaggcttccgctgtcctgggccctggggtcccggagtcgggctcagatgaaagggttccccccttccaggggcccacgagactctataatcctggctgggaggccagcagcgccctcctggggcccagactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 960 - DNA, 5469 bp, Homo sapiens
gccctcggacagtccctgctcgcccgcgcgctgcagccccatctcctagcggcagcccaggcgcggagggagcgagtccgccccgaggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgccgagggactactccaccctcacctccgtctcctcccacggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 961 - DNA, 5988 bp, Homo sapiens
gccctcggacagtccctgctcgcccgcgcgctgcagccccatctcctagcggcagcccaggcgcggagggagcgagtccgccccgaggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactggctgcggctggaagttcgagcccctgctgggggaggagctggacctgcggcgcgtcacgtggcggctgcccccggagctcatcccgcgcctgtcggccagcagcgggcgctcctccgacgccgaggcgccccacgggcccccggacgacggcggcgcgggcgggaagggcggcagcctgccccgcagtgcgacacccgggccccccggagagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgccgagggactactccaccctcacctccgtctcctcccacggcctccctcccatctgggaacacgggaggagcaggcttccgctgtcctgggccctggggtcccggagtcgggctcagatgaaagggttccccccttccaggggcccacgagactctataatcctggctgggaggccagcagcgccctcctggggcccagactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 962 - DNA, 5829 bp, Homo sapiens
gccctcggacagtccctgctcgcccgcgcgctgcagccccatctcctagcggcagcccaggcgcggagggagcgagtccgccccgaggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactggctgcggctggaagttcgagcccctgctgggggaggagctggacctgcggcgcgtcacgtggcggctgcccccggagctcatcccgcgcctgtcggccagcagcgggcgctcctccgacgccgaggcgccccacgggcccccggacgacggcggcgcgggcgggaagggcggcagcctgccccgcagtgcgacacccgggccccccggagagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgccgagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 963 - DNA, 5994 bp, Homo sapiens
gcgctgcccgcctcgtccccaccccccaaccccccgcgcccgccctcggacagtccctgctcgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctgtgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggcgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactggctgcggctggaagttcgagcccctgctgggggaggagctggacctgcggcgcgtcacgtggcggctgcccccggagctcatcccgcgcctgtcggccagcagcgggcgctcctccgacgccgaggcccccacggccccccggacgacggcggcgcgggcgggaagggcggcagccgtgccccgcagtgcgacacccgggccccccggagagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccatgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgctaaaaaaaaaaaaaaaaaaaaaaaaaaaaaaaaaaaaaaaaaaaaaaaaaaaaaaaaaaaaaaaaaaaaaaaaaaaa

SEQ ID NO: 964 - DNA, 5920 bp, Homo sapiens
gccctcggacagtccctgctcgcccgcgcgctgcagccccatctcctagcggcagcccaggcgcggagggagcgagtccgccccgaggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaagggcaccacctccccctgcctcctcctctccagactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactggctgcggctggaagttcgagcccctgctgggggaggagctggacctgcggcgcgtcacgtggcggctgcccccggagctcatcccgcgcctgtcggccagcagcgggcgctcctccgacgccgaggcgccccacgggcccccggacgacggcggcgcgggcgggaagggcggcagcctgccccgcagtgcgacacccgggccccccggagagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgccgagggactactccaccctcacctccgtctcctcccacggcctccctcccatctgggaacacgggaggagcaggcttccgctgtcctgggccctggggtcccggagtcgggctcagatgaaagggttccccccttccaggggcccacgagactctataatcctggctgggaggccagcagcgccctcctggggcccagactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 965 - DNA, 5866 bp, Homo sapiens
gccctcggacagtccctgctcgcccgcgcgctgcagccccatctcctagcggcagcccaggcgcggagggagcgagtccgccccgaggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacgtaaggacccaggaactaggcctggccggagatgtggctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactggctgcggctggaagttcgagcccctgctgggggaggagctggacctgcggcgcgtcacgtggcggctgcccccggagctcatcccgcgcctgtcggccagcagcgggcgctcctccgacgccgaggcgccccacgggcccccggacgacggcggcgcgggcgggaagggcggcagcctgccccgcagtgcgacacccgggccccccggagagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgccgagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 966 - DNA, 5648 bp, Homo sapiens
cgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgccgagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 967 - DNA, 6017 bp, Homo sapiens
cgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactggctgcggctggaagttcgagcccctgctgggggaggagctggacctgcggcgcgtcacgtggcggctgcccccggagctcatcccgcgcctgtcggccagcagcgggcgctcctccgacgccgaggcgccccacgggcccccggacgacggcggcgcgggcgggaagggcggcagcctgccccgcagtgcgacacccgggccccccggagagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgccgagggactactccaccctcacctccgtctcctcccacggcctccctcccatctgggaacacgggaggagcaggcttccgctgtcctgggccctggggtcccggagtcgggctcagatgaaagggttccccccttccaggggcccacgagactctataatcctggctgggaggccagcagcgccctcctggggcccagactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 968 - DNA, 5619 bp, Homo sapiens
gccctcggacagtccctgctcgcccgcgcgctgcagccccatctcctagcggcagcccaggcgcggagggagcgagtccgccccgaggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgccgagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 969 - DNA, 1130 bp, Homo sapiens
acccgggaaaccggaagccgcctcccacttggttgctcgtacgcggctagtgggtcctcagtggatgtaggctgggcgccgcgatgttcgacgggacaccggcggagagcgacctcggggttaaggggtggggctgacgtcaggagccaagatggcggcggtggtcgcactctccttgaggcgccggttgccggccacaacccttggcggagcctgcctgcaggcctcccgaggagcccagacagctgcagccacagctccccgtatcaagaaatttgccatctatcgatgggacccagacaaggctggagacaaacctcatatgcagacttatgaagttgaccttaataaatgtggccccatggtattggatgctttaatcaagattaagaatgaagttgactctactttgaccttccgaagatcatgcagagaaggcatctgtggctcttgtgcaatgaacatcaatggaggcaacactctagcttgcacccgaaggattgacaccaacctcaataaggtctcaaaaatctaccctcttccacacatgtatgtgataaaggatcttgttcccgatttgagcaacttctatgcacagtacaaatccattgagccttatttgaagaagaaggatgaatctcaggaaggcaagcagcagtatctgcagtccatagaagagcgtgagaaactggacgggctctacgagtgcattctctgtgcctgctgtagcaccagctgccccagctactggtggaacggagacaaatatctggggcctgcagttcttatgcaggcctatcgctggatgattgactccagagatgacttcacagaggagcgcctggccaagctgcaggacccattctctctataccgctgccacaccatcatgaactgcacaaggacctgtcctaagggtctgaatccagggaaagctattgcagagatcaagaaaatgatggcaacctataaggagaagaaagcttcagtttaactgtttccatgctaaacatgatttataaccagctcagagctgaacataatttatatctaatttgagttcctttaaagatcttggttttccatgaatacagcatgtataataaaaaaaaaaaaaaaaaaaaaaaaaa

SEQ ID NO: 970 - DNA, 1006 bp, Homo sapiens
ccaagatggcggcggtggtcgcactctccttgaggcgccggttgccggccacaacccttggcggagcctgcctgcctcccgaggagcccagacagctgcagccacagctccccgtatcaagaaatttgccatctatcgatgggacccagacaaggctggagacaaacctcatatgcagacttatgaagttgaccttaataaatgtggccccatggtattggatgctttaatcaagattaagaatgaagttgactctactttgaccttccgaagatcatgcagagaaggcatctgtggctcttgtgcaatgaacatcaatggaggcaacactctagcttgcacccgaaggattgacaccaacctcaataaggtctcaaaaatctaccctcttccacacatgtatgtgataaaggatcttgttcccgatttgagcaacttctatgcacagtacaaatccattgagccttatttgaagaagaaggatgaatctcaggaaggcaagcagcagtatctgcagtccatagaagagcgtgagaaactggacgggctctacgagtgcattctctgtgcctgctgtagcaccagctgccccagctactggtggaacggagacaaatatctggggcctgcagttcttatgcaggcctatcgctggatgattgactccagagatgacttcacagaggagcgcctggccaagctgcaggacccattctctctataccgctgccacaccatcatgaactgcacaaggacctgtcctaagggtctgaatccagggaaagctattgcagagatcaagaaaatgatggcaacctataaggagaagaaagcttcagtttaactgtttccatgctaaacatgatttataaccagctcagagctgaacataatttatatctaatttgagttcctttaaagatcttggttttccatgaatacagcatgtataataaaaattttaagaaataaatgttattctactttattaacaaaaaaaaaagaa

SEQ ID NO: 971 - DNA, 1157 bp, Homo sapiens
cacccgggaaaccggaagccgcctcccacttggttgctcgtacgcggctagtgggtcctcagtggatgtaggctgggcgccgcgatgttcgacgggacaccggcggagagcgacctcggggttaaggggtggggctgacgtcaggagccaagatggcggcggtggtcgcactctccttgaggcgccggttgccggccacaacccttggcggagcctgcctgcaggcctcccgaggagcccagacagctgcagccacagctccccgtatcaagaaatttgccatctatcgatgggacccagacaaggctggagacaaacctcatatgcagacttatgaagttgaccttaataaatgtggccccatggtattggatgctttaatcaagattaagaatgaagttgactctactttgaccttccgaagatcatgcagagaaggcatctgtggctcttgtgcaatgaacatcaatggaggcaacactctagcttgcacccgaaggattgacaccaacctcaataaggtctcaaaaatctaccctcttccacacatgtatgtgataaaggatcttgttcccgatttgagcaacttctatgcacagtacaaatccattgagccttatttgaagaagaaggatgaatctcaggaaggcaagcagcagtatctgcagtccatagaagagcgtgagaaactggacgggctctacgagtgcattctctgtgcctgctgtagcaccagctgccccagctactggtggaacggagacaaatatctggggcctgcagttcttatgcaggcctatcgctggatgattgactccagagatgacttcacagaggagcgcctggccaagctgcaggacccattctctctataccgctgccacaccatcatgaactgcacaaggacctgtcctaagggtctgaatccagggaaagctattgcagagatcaagaaaatgatggcaacctataaggagaagaaagcttcagtttaactgtttccatgctaaacatgatttataaccagctcagagctgaacataatttatatctaatttgagttcctttaaagatcttggttttccatgaatacagcatgtataataaaaattttaagaaataaatgttattctactttattaacaaaaaaaaaagaa

SEQ ID NO: 972 - DNA, 2306 bp, Homo sapiens
cccctcggaccaccggactggcctggggcgggacgtgggcgcgggggcgcggcgtgcggcacgctgcagggctgaagcggcggcggcggtggggactgcacgtagcccggcgctcggcatggctctcctggtgctcggtctggtgagctgtaccttctttctggcagtgaatggtctgtattcctctagtgatgatgtgatcgaattaactccatcgaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaaatattttggacaatgccgataaatgtatgaagttagtatccacatcataaattcagagtgatgtttagcagtaaatcaatattttgaagtgatacacagatgtctttcctccccacaaacttttttaaacaaaaaacaagacctcttttctttagatggtgccacctatgcccaccacaacagagattttacatggaaaccgggctcagtgagaactgatttcctgcccaatatttgtctttgggctgtctctagtgactaattattaaggaatctagctggttatacagttcaaggctttctatgttgttaatgaacctcaaaatagccgttaagacatgaaatacagcagcaggttaccaatgcgaacaggtagttcgcatttatgtaaaacattcagaaaatgaagttttgaatttgttggaacattcaaaggacttgagagcattttattgtaacttaaaaaaataaatacaactgtcact

SEQ ID NO: 973 - DNA, 2179 bp, Homo sapiens
gcacttttgtttttatcttcaggtctggtgagctgtaccttctttctggcagtgaatggtctgtattcctctagtgatgatgtgatcgaattaactccatcgaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtgagagccacaacagaggcttcagaccattttcttttcttgggagccagtggatttttccagcatctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaaatattttggacaatgccgataaatgtatgaagttagtatccacatcataaattcagagtgatgtttagcagtaaatcaatattttgaagtgatacacagatgtctttcctccccacaaacttttttaaacaaaaaacaagacctcttttctttagatggtgccacctatgcccaccacaacagagattttacatggaaaccgggctcagtgagaactgatttcctgcccaatatttgtctttgggctgtctctagtgactaattattaaggaatctagctggttatacagttcaaggctttctatgttgttaatgaacctcaaaatagccgttaagacatgaaatacagcagcaggttaccaatgcgaacaggtagttcgcatttatgtaaaacattcagaaaatgaagttttgaatttgttggaacattcaaaggacttgagagcattttattgtaacttaaaaaaataaatacaactgtcact

SEQ ID NO: 974 - DNA, 2344 bp, Homo sapiens
ggcccgcccccgcgcggccgcccctcggaccaccggactggcctggggcgggacgtgggcgcgggggcgcggcgtgcggcacgctgcagggctgaagcggcggcggcggtggggactgcacgtagcccggcgctcggcatggctctcctggtgctcggtctggtgagctgtaccttctttctggcagtgaatggtctgtattcctctagtgatgatgtgatcgaattaactccatcgaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaaatattttggacaatgccgataaatgtatgaagttagtatccacatcataaattcagagtgatgtttagcagtaaatcaatattttgaagtgatacacagatgtctttcctccccacaaacttttttaaacaaaaaacaagacctcttttctttagatggtgccacctatgcccaccacaacagagattttacatggaaaccgggctcagtgagaactgatttcctgcccaatatttgtctttgggctgtctctagtgactaattattaaggaatctagctggttatacagttcaaggctttctatgttgttaatgaacctcaaaatagccgttaagacatgaaatacagcagcaggttaccaatgcgaacaggtagttcgcatttatgtaaaacattcagaaaatgaagttttgaatttgttggaacattcaaaggacttgagagcattttattgtaacttaaaaaaataaatacaactgtcactaaaaaaaaaaaaaaaaaa

SEQ ID NO: 975 - DNA, 1090 bp, Homo sapiens
gggggtttccgggaggcgcgtggggcttgaggccgagaacggcccttgctgccaccaacatggagactttgtaccgtgtcccgttcttagtgctcgaatgtcccaacctgaagctgaagaagccgccctggttgcacatgccgtcggccatgactgtgtatgctctggtggtggtgtcttacttcctcatcaccggaggaataatttatgatgttattgttgaacctccaagtgtcggttctatgactgatgaacatgggcatcagaggccagtagctttcttggcctacagagtaaatggacaatatattatggaaggacttgcatccagcttcctatttacaatgggaggtttaggtttcataatcctggaccgatcgaatgcaccaaatatcccaaaactcaatagattccttcttctgttcattggattcgtctgtgtcctattgagttttttcatggctagagtattcatgagaatgaaactgccgggctatctgatgggttagagtgcctctgagaagaaatcagtggatactggatttgctcctgtcaatgaagttttaaaggctgtaccaatcctctaatatgaaatgtggaaaagaatgaagagcagcagtaaaagaaatatctagtgaaaaaacaggaagcgtattgaagcttggactagaatttcttcttggtattaaagagacaagtttatcacagaattttttttcctgctggcctattgctataccaatgatgttgagtggcattttctttttagtttttcattaaaatatattccatatctacaactataatatcaaataaagtgattattttttacaaccctcttaacattttttggagatgacatttctgattttcagaaattaacataaaatccagaagcaagattccgtaagctgagaactctggacagttgatcagctttacctatggtgctttgcctttaactagagtgtgtgatggtagattatttcagatatgtatgtaaaactgtttcctgaacaataagatgtatgaacggagcagaaataaatactttttctaaaaaaaaaaaaaaaaaaaaaaaaaaaaaaaa

SEQ ID NO: 976 - DNA, 1000 bp, Homo sapiens
ggagggcgggcctgtttccgggaggcgcgtggggcttgaggccgagaacggcccttgctgccaccaacatggagactttgtaccgtgtcccgttcttagtgctcgaatgtcccaacctgaagctgaagaagccgccctggttgcacatgccgtcggccatgactgtgtatgctctggtggtggtgtcttacttcctcatcaccggaggaataatttatgatgttattgttgaacctccaagtgtcggttctatgactgatgaacatgggcatcagaggccagtagctttcttggcctacagagtaaatggacaatatattatggaaggacttgcatccagcttcctatttacaatgggaggtttaggtttcataatcctggaccgatcgaatgcaccaaatatcccaaaactcaatagattccttcttctgttcattggattcgtctgtgtcctattgagttttttcatggctagagtattcatgagaatgaaactgccgggctatctgatgggttagagtgcctttgagaagaaatcagtggatactggatttgctcctgtcaatgaagttttaaaggctgtaccaatcctctaatatgaaatgtggaaaagaatgaagagcagcagtaaaagaaatatctagtgaaaaaacaggaagcgtattgaagcttggactagaatttcttcttggtattaaagagacaagtttatcacagaattttttttcctgctggcctattgctataccaatgatgttgagtggcattttctttttagtttttcattaaaatatattccatatctacaactataatatcaaataaagtgattattttttacaaccctcttaacattttttggagatgacatttctgattttcagaaattaacataaaatccagaagcaagattccgtaagctgagaactctgggatatgtatgtaaaactgtttcctgaacaataagatgtatgaacggagcagaaataaatactttttc

SEQ ID NO: 977 - DNA, 1071 bp, Homo sapiens
ggagggcgggcctgtttccgggaggcgcgtggggcttgaggccgagaacggcccttgctgccaccaacatggagactttgtaccgtgtcccgttcttagtgctcgaatgtcccaacctgaagctgaagaagccgccctggttgcacatgccgtcggccatgactgtgtatgctctggtggtggtgtcttacttcctcatcaccggaggaataatttatgatgttattgttgaacctccaagtgtcggttctatgactgatgaacatgggcatcagaggccagtagctttcttggcctacagagtaaatggacaatatattatggaaggacttgcatccagcttcctatttacaatgggaggtttaggtttcataatcctggaccgatcgaatgcaccaaatatcccaaaactcaatagattccttcttctgttcattggattcgtctgtgtcctattgagttttttcatggctagagtattcatgagaatgaaactgccgggctatctgatgggttagagtgcctttgagaagaaatcagtggatactggatttgctcctgtcaatgaagttttaaaggctgtaccaatcctctaatatgaaatgtggaaaagaatgaagagcagcagtaaaagaaatatctagtgaaaaaacaggaagcgtattgaagcttggactagaatttcttcttggtattaaagagacaagtttatcacagaattttttttcctgctggcctattgctataccaatgatgttgagtggcattttctttttagtttttcattaaaatatattccatatctacaactataatatcaaataaagtgattattttttacaaccctcttaacattttttggagatgacatttctgattttcagaaattaacataaaatccagaagcaagattccgtaagctgagaactctggacagttgatcagctttacctatggtgctttgcctttaactagagtgtgtgatggtagattatttcagatatgtatgtaaaactgtttcctgaacaataagatgtatgaacggagcagaaataaatactttttctaatt

SEQ ID NO: 978 - DNA, 1566 bp, Homo sapiens
cccgcggccccgcccgcctccgcctccggctccccgcactctccgggtccacgcatcgtcctcccgcgcgcccgcccgcccatggccgggaaggtgcggtcactgctgccgccgctgctgctggccgccgcgggcctcgccggcctcctactgctgtgcgtccccacccgcgacgtccgggagccgcccgccctcaagtatggcatcgtcctggacgctggttcttcacacacgtccatgtttatctacaagtggccggcagacaaggagaacgacacaggcattgtgggccagcacagctcctgtgatgttccaggtgggggcatctccagctatgcagacaacccttctggggccagccagagtcttgttggatgcctcgaacaggcgcttcaggatgtgcccaaagagagacacgcgggcacacccctctacctgggagccacagcgggtatgcgcctgctcaacctgaccaatccagaggcctcgaccagtgtgctcatggcagtgactcacacactgacccagtacccctttgacttccggggtgcacgcatcctctcgggccaggaagagggggtgtttggctgggtgactgccaactacctgctggagaacttcatcaagtacggctgggtgggccggtggttccggccacggaaggggacactgggggccatggacctggggggtgcctctacccagatcacttttgagacaaccagtccagctgaggacagagccagcgaggtccagctgcatctctacggccagcactaccgagtctacacccacagcttcctctgctatggccgtgaccaggtcctccagaggctgctggccagcgccctccagacccacggcttccacccctgctggccgaggggcttttccacccaagtgctgctcggggatgtgtaccagtcaccatgcaccatggcccagcggccccagaacttcaacagcagtgccagggtcagcctgtcagggagcagtgacccccacctctgccgagatctggtttctgggctcttcagcttctcctcctgccccttctcccgatgctctttcaatggggtcttccagcccccagtggctgggaactttgtggccttctctgccttcttctacactgtggactttttgcggacttcgatggggctgcccgtggccaccctgcagcagctggaggcagccgcagtgaatgtctgcaaccagacctgggctcagctgcaagctcgggtgccagggcaacgggcccgcctggccgactactgcgccggggccatgttcgtgcagcagctgctgagtcgcggctacggcttcgatgagcgcgccttcggcggcgtgatcttccagaagaaggccgcggacactgcagtgggctgggcgctcggctacatgctgaacctgaccaacctgatccccgccgacccgccggggctgcgcaagggcacagacttcagctcctgggtcgtcctcctgctgctcttcgcctccgcgctcctggctgcgcttgtcctgctgctgcgtcaggtgcactccgccaagctgccaagcaccatt

SEQ ID NO: 979 - DNA, 1488 bp, Homo sapiens
atggccgggaaggtgcggtcactgctgccgccgctgctgctggccgccgcgggcctcgccggcctcctactgctgtgcgtccccacccgcgacgtccgggagccgcccgccctcaagtatggcatcgtcctggacgctggttcttcacacacgtccatgtttatctacaagtggccggcagacaaggagaacgacacaggcattgtgggccagcacagctcctgtgatgttccaggtgggggcatctccagctatgcagacaacccttctggggccagccagagtcttgttggatgcctcgaacaggcgcttcaggatgtgcccaaagagagacacgcgggcacacccctctacctgggagccacagcgggtatgcgcctgctcaacctgaccaatccagaggcctcgaccagtgtgctcatggcagtgactcacacactgacccagtacccctttgacttccggggtgcacgcatcctctcgggccaggaagagggggtgtttggctgggtgactgccaactacctgctggagaacttcatcaagtacggctgggtgggccggtggttccggccacggaaggggacactgggggccatggacctggggggtgcctctacccagatcacttttgagacaaccagtccagctgaggacagagccagcgaggtccagctgcatctctacggccagcactaccgagtctacacccacagcttcctctgctatggccgtgaccaggtcctccagaggctgctggccagcgccctccagacccacggcttccacccctgctggccgaggggcttttccacccaagtgctgctcggggatgtgtaccagtcaccatgcaccatggcccagcggccccagaacttcaacagcagtgccagggtcagcctgtcagggagcagtgacccccacctctgccgagatctggtttctgggctcttcagcttctcctcctgccccttctcccgatgctctttcaatggggtcttccagcccccagtggctgggaactttgtggccttctctgccttcttctacactgtggactttttgcggacttcgatggggctgcccgtggccaccctgcagcagctggaggcagccgcagtgaatgtctgcaaccagacctgggctcagctgcaagctcgggtgccagggcaacgggcccgcctggccgactactgcgccggggccatgttcgtgcagcagctgctgagtcgcggctacggcttcgacgagcgcgccttcggcggcgtgatcttccagaagaaggccgcggacactgcagtgggctgggcgctcggctacatgctgaacctgaccaacctgatccccgccgacccgccggggctgcgcaagggcacagacttcagctcctgggtcgtcctcctgctgctcttcgcctccgcgctcctggctgcgcttgtcctgctgctgcgtcaggtgcactccgccaagctgccaagcaccatttag

SEQ ID NO: 980 - DNA, 2056 bp, Homo sapiens
cccgcggccccgcccgcctccgcctccggctccccgcactctccgggtccacgcatcgtcctcccgcgcgcccgcccgcccatggccgggaaggtgcggtcactgctgccgccgctgctgctggccgccgcgggcctcgccggcctcctactgctgtgcgtccccacccgcgacgtccgggagccgcccgccctcaagtatggcatcgtcctggacgctggttcttcacacacgtccatgtttatctacaagtggccggcagacaaggagaacgacacaggcattgtgggccagcacagctcctgtgatgttccaggtgggggcatctccagctatgcagacaacccttctggggccagccagagtcttgttggatgcctcgaacaggcgcttcaggatgtgcccaaagagagacacgcgggcacacccctctacctgggagccacagcgggtatgcgcctgctcaacctgaccaatccagaggcctcgaccagtgtgctcatggcagtgactcacacactgacccagtacccctttgacttccggggtgcacgcatcctctcgggccaggaagagggggtgtttggctgggtgactgccaactacctgctggagaacttcatcaagtacggctgggtgggccggtggttccggccacggaaggggacactgggggccatggacctggggggtgcctctacccagatcacttttgagacaaccagtccagctgaggacagagccagcgaggtccagctgcatctctacggccagcactaccgagtctacacccacagcttcctctgctatggccgtgaccaggtcctccagaggctgctggccagcgccctccagacccacggcttccacccctgctggccgaggggcttttccacccaagtgctgctcggggatgtgtaccagtcaccatgcaccatggcccagcggccccagaacttcaacagcagtgccagggtcagcctgtcagggagcagtgacccccacctctgccgagatctggtttctgggctcttcagcttctcctcctgccccttctcccgatgctctttcaatggggtcttccagcccccagtggctgggaactttgtggccttctctgccttcttctacactgtggactttttgcggacttcgatggggctgcccgtggccaccctgcagcagctggaggcagccgcagtgaatgtctgcaaccagacctgggctcagcagctgctgagtcgcggctacggcttcgatgagcgcgccttcggcggcgtgatcttccagaagaaggccgcggacactgcagtgggctgggcgctcggctacatgctgaacctgaccaacctgatccccgccgacccgccggggctgcgcaagggcacagacttcagctcctgggtcgtcctcctgctgctcttcgcctccgcgctcctggctgcgcttgtcctgctgctgcgtcaggtgcactccgccaagctgccaagcaccatttaggggccgacgggggcagctgccccatccctcccccaacccctgtatccccaccccgtactcccacccctcccacaacccctgtacctcccacccctgtatccccacccctccacccacccctctcccaacctctctccccgcccctgtatcctgcattcctccacccaccctctatcccccaccgctccaccccaccactgtcttctccatccttccaccccaccctcagcgtctctgcccctaaggcagcccaggaaataggaactgagactctggtacccacaggagcctgggtgggcaaagagcgctcaatccagctccttgaacccctccagcccgcttcagcctgggcatcactgcaggccccgtgctcctcctcctcctcctcagggctgggtctccagagagtggggccttggtcctgagaatcagcccttagaggctccttctgtgtagtctgggtctgtactggggagggtcacagcccacgggctggcagccagcccagcacctacttgtaaaaattttgtaataaaaagtttttcctagagacgtg

SEQ ID NO: 981 - DNA, 1280 bp, Homo sapiens
ggccgggggctggccccaggtaacccctccgcgtatgggaccgagctgggccaggtctcctggccgggccggggataccgtggggtatgcccagtgatgccagcagcttgtggcacctgggcgcaccctccagctcgggccccttccgatgggtctgctggctcaggtgcgggcgatggccggggagccgcgccccgcacgtgactcagcactttccccagagcccggactgcggagaacaatatcctcctccctaacagataaacagcccttgttcctcgggataaggactggcagtcccctgacaccctaagaccggcatctgtcgatgttatttccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagggggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacactggagaaatggtttttattgtcaaccttaacacccatcaccaaatcggtaatttcagggtctaaaaaaagtcagcatgttttaactttgttgttttactatcctcaggcatccattccaatcaagaaatgatggagctttggaaaaataaagatttgtcagccctatctcaaacttgaatcaaaatttctggggtgtgggc

SEQ ID NO: 982 - DNA, 1740 bp, Homo sapiens
ggccgggggctggccccaggtaacccctccgcgtatgggaccgagctgggccaggtctcctggccgggccggggataccgtggggtatgcccagtgatgccagcagcttgtggcacctgggcgcaccctccagctcgggccccttccgatgggtctgctggctcaggtgcgggcgatggccggggagccgcgccccgcacgtgactcagcactttccccagagcccggactgcggagaacaatatcctcctccctaacagataaacagcccttgttcctcgggataaggactggcagtcccctgacaccctaagaccggcatctgtcgatgttatttccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagggggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacactggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatgaatggacaactcctgggtgcctcttagattgcttgaaaatgcccatgtagtgtgatatgcagcatttcagcctatggggtgatataatagcagctaatattta

SEQ ID NO: 983 - DNA, 1535 bp, Homo sapiens
acccccccggtccgaccagggaaggtgggatgctctgatggccgggcctgcggcgctgagcgcggcggcggcggctgctctggcggccgccctgctcctgctgcgtcgtgaggacccggggccgggggctggccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagggggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacactggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatgaatggacaactcctgggtgcctcttagattgcttgaaaatgcccatgtagtgtgatatgcagcatttcagcctatggggtgatataatagcagctaatattta

SEQ ID NO: 984 - DNA, 1438 bp, Homo sapiens
ggatgctctgatggccgggcctgcggcgctgagcgcggcggcggcggctgctctggcggccgccctgctcctgctgcgtcgtgaggacccggggccgggggctggccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagggggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacactggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatgaatggacaactccaaaaaaaaaaaaaaaaaaaa

SEQ ID NO: 985 - DNA, 1152 bp, Homo sapiens
aggcggcggccccctagcgtcgcgcagggtcggggactgcgcggcggtgccaggccgggcgtgggcgagagcacgaacgggctgcctgcgggctgagagcgtcgagctgtcaccatgggtgatcacgcttggagcttcctaaaggacttcctggccgggggcgtcgccgctgccgtctccaagaccgcggtcgcccccatcgagagggtcaaactgctgctgcaggtccagcatgccagcaaacagatcagtgctgagaagcagtacaaagggatcattgattgtgtggtgagaatccctaaggagcagggcttcctctccttctggaggggtaacctggccaacgtgatccgttacttccccacccaagctctcaacttcgccttcaaggacaagtacaagcagctcttcttagggggtgtggatcggcataagcagttctggcgctactttgctggtaacctggcgtccggtggggccgctggggccacctccctttgctttgtctacccgctggactttgctaggaccaggttggctgctgatgtgggcaagggcgccgcccagcgtgagttccatggtctgggcgactgtatcatcaagatcttcaagtctgatggcctgagggggctctaccagggtttcaacgtctctgtccaaggcatcattatctatagagctgcctacttcggagtctatgatactgccaaggggatgctgcctgaccccaagaacgtgcacatttttgtgagctggatgattgcccagagtgtgacggcagtcgcagggctggtgtcctacccctttgacactgttcgtcgtagaatgatgatgcagtccggccggaaaggggccgatattatgtacacggggacagttgactgctggaggaagattgcaaaagacgaaggagccaaggccttcttcaaaggtgcctggtccaatgtgctgagaggcatgggcggtgcttttgtattggtgttgtatgatgagatcaaaaaatatgtctaatgtaattaaaacacaagtattttgtatttattttacatttaaattcccacagcaaatagaaaataatttatcatacttgtacaattaactgaagaattgataataactgaatgtgaaacatcaataaagaccacttaatgc

SEQ ID NO: 986 - DNA, 1324 bp, Homo sapiens
aggcggcggccccctagcgtcgcgcagggtcggggactgcgcggcggtgccaggccgggcgtgggcgagagcacgaacgggctgcctgcgggctgagagcgtcgagctgtcaccatgggtgatcacgcttggagcttcctaaaggacttcctggccgggggcgtcgccgctgccgtctccaagaccgcggtcgcccccatcgagagggtcaaactgctgctgcaggtccagcatgccagcaaacagatcagtgctgagaagcagtacaaagggatcattgattgtgtggtgagaatccctaaggagcagggcttcctctccttctggaggggtaacctggccaacgtgatccgttacttccccacccaagctctcaacttcgccttcaaggacaagtacaagcagctcttcttagggggtgtggatcggcataagcagttctggcgctactttgctggtaacctggcgtccggtggggccgctggggccacctccctttgctttgtctacccgctggactttgctaggaccaggttggctgctgatgtgggcaagggcgccgcccagcgtgagttccatggtctgggcgactgtatcatcaagatcttcaagtctgatggcctgagggggctctaccagggtttcaacgtctctgtccaaggcatcattatctatagagctgcctacttcggagtctatgatactgccaaggggatgctgcctgaccccaagaacgtgcacatttttgtgagctggatgattgcccagagtgtgacggcagtcgcagggctggtgtcctacccctttgacactgttcgtcgtagaatgatgatgcagtccggccggaaaggggccgatattatgtacacggggacagttgactgctggaggaagattgcaaaagacgaaggagccaaggccttcttcaaaggtgcctggtccaatgtgctgagaggcatgggcggtgcttttgtattggtgttgtatgatgagatcaaaaaatatgtctaatgtaattaaaacacaagttcacagatttacagtgaacttgatctacaagttcacagatccattgtgtggtttaatagactattcctaggggaagtaaaaagatctgggataaaaccagactgaaaggaatacctcagaagagatgcttcattgagtgttcattaaaccacacatgtattttgtatttattttacatttaaattcccacagcaaatagaaaataatttatcatacttgtacaattaactgaagaattgataataactgaatgtgaaacatcaataaagaccacttaatgcacgctttctatttt

SEQ ID NO: 987 - DNA, 1320 bp, Homo sapiens
ccccctagcgtcgcgcagggtcggggactgcgcgcggtgccaggccgggcgtgggcgagagcacgaacgggctgctgcgggctgagagcgtcgagctgtcaccatgggtgatcacgcttggagcttcctaaaggacttcctggccggggcggtcgccgctgccgtctccaagaccgcggtcgcccccatcgagagggtcaaactgctgctgcaggtccagcatgccagcaaacagatcagtgctgagaagcagtacaaagggatcattgattgtgtggtgagaatccctaaggagcagggcttcctctccttctggaggggtaacctggccaacgtgatccgttacttccccacccaagctctcaacttcgccttcaaggacaagtacaagcagctcttcttagggggtgtggatcggcataagcagttctggcgctactttgctggtaacctggcgtccggtggggccgctggggccacctccctttgctttgtctacccgctggactttgctaggaccaggttggctgctgatgtgggcaggcgcgcccagcgtgagttccatggtctgggcgactgtatcatcaagatcttcaagtctgatggcctgagggggctctaccagggtttcaacgtctctgtccaaggcatcattatctatagagctgcctacttcggagtctatgatactgccaaggggatgctgcctgaccccaagaacgtgcacatttttgtgagctggatgattgcccagagtgtgacggcagtcgcagggctgctgtcctacccctttgacactgttcgtcgtagaatgatgatgcagtccggccggaaaggggccgatattatgtacacggggacagttgactgctggaggaagattgcaaaagacgaaggagccaaggccttcttcaaaggtgcctggtccaatgtgctgagaggcatgggcggtgcttttgtattggtgttgtatgatgagatcaaaaaatatgtctaatgtaattaaaacacaagttcacagatttacatgaacttgatctacaagttcacagatccattgtgtggtttaatagactattcctaggggaagtaaaaagatctgggataaaaccagactgaaaggaatacctcagaagagatgcttcattgagtgttcattaaaccacacatgtattttgtatttattttacatttaaattcccacagcaaatagaaataatttatcatacttgtacaattaactgaagaattgataataactgaatgtgaaacatcaataaagaccacttaatgcacaaaaaaaaaaaaaaaaaaaaaaaa

SEQ ID NO: 988 - DNA, 1319 bp, Homo sapiens
gcgtcgcgcagggtcggggactgcgcggcggtgccaggccgggcgtgggcgagagcacgaacgggctgcctgcgggctgagagcgtcgagctgtcaccatgggtgatcacgcttggagcttcctaaaggacttcctggccgggggcgtcgccgctgccgtctccaagaccgcggtcgcccccatcgagagggtcaaactgctgctgcaggtccagcatgccagcaaacagatcagtgctgagaagcagtacaaagggatcattgattgtgtggtgagaatccctaaggagcagggcttcctctccttctggaggggtaacctggccaacgtgatccgttacttccccacccaagctctcaacttcgccttcaaggacaagtacaagcagctcttcttagggggtgtggatcggcataagcagttctggcgctactttgctggtaacctggcgtccggtggggccgctggggccacctccctttgctttgtctacccgctggactttgctaggaccaggttggctgctgatgtgggcaagggcgccgcccagcgtgagttccatggtctgggcgactgtatcatcaagatcttcaagtctgatggcctgagggggctctaccagggtttcaacgtctctgtccaaggcatcattatctatagagctgcctacttcggagtctatgatactgccaaggggatgctgcctgaccccaagaacgtgcacatttttgtgagctggatgattgcccagagtgtgacggcagtcgcagggctggtgtcctacccctttgacactgttcgtcgtagaatgatgatgcagtccggccggaaaggggccgatattatgtacacggggacagttgactgctggaggaagattgcaaaagacgaaggagccaaggccttcttcaaaggtgcctggtccaatgtgctgagaggcatgggcggtgcttttgtattggtgttgtatgatgagatcaaaaaatatgtctaatgtaattaaaacacaagttcacagatttacagtgaacttgatctacaagttcacagatccattgtgtggtttaatagactattcctaggggaagtaaaaagatctgggataaaaccagactgaaaggaatacctcagaagagatgcttcattgagtgttcattaaaccacacatgtattttgtatttattttacatttaaattcccacagcaaatagaaaataatttatcatacttgtacaattaactgaagaattgataataactgaatgtgaaacatcaataaagaccacttaatgcacgctttctaaaaaaaaaaaaaaaa

SEQ ID NO: 989 - DNA, 2967 bp, Homo sapiens
aaaatactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgactccatcagcagtggtgcttactactggagctgggtccgccagtacccagggaagagcctggagtatattgggtacatctcttacagtgggaacacccactaccacccgtccctcaagagtcgacttaccatgtcagtcgacacatctaacaaccagttctccctgaagttgacgtctgtgactgccgctgacacggccgtatattattgtgcgagatctttgactatgtttgggggagttgtcgctgtaccctccttctttgactactggggccagggaaccctggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccggctgtcctacagtcctcaggactctactccctcagcagcgtggtgaccgtgacctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcatggaggtgcataatgccaagacaaagccacgggaggagcagttcaacagcacgttccgtgtggtcagcgtcctcaccgtcgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccggagctgcaactggaggagagctgtgcggaggcgcaggacggggagctggacgggctgtggaccaccatcaccatcttcatcacactcttcctgctaagcgtgtgctacagtgccaccatcaccttcttcaaggtgaagtggatcttctcctcagtggtggacctgaagcagaccatcgtccccgactacagaaacatgatcaggcagggggcctagggccaccctctgtggggtgtccagggccgcccagaccccacacaggagccgtgggccatgctcagccatcacccaggccacacctgcccccgacctcaccgccctcaaccccatggctctctggcctcgcagtcgccctctgaccctgacacgccccccttccagaccctgtgcatagcaggtctaccccagacctccgctgcttggtgcatgcagggcgctgggggccaggtgtcccctcagcaggacgtccctgccctccggcccgccaggtgctcacacaaaaggaggtagtgaccagcatcccaggcccccactcaggcaggacctcgccctggagccaaccctgtccacgccagcctcctgaacacaggcgtggtttccagatgcccgcagccagccagcctccattccaggcactcccgtgaactcctgacatgaggaatgaggttgttctgatttcaagcaaagaacgctgctctctggctcctgggaacagtctcagtgccagcaccaccccttggctgcctgcccacactgctggattctcgggtggaactcgacccgcagggacagccagccccagagtccgcactggggagagaaggggccaggcccaggacactgccacctaccacccactcgagtccaccgagatcactcggagaagagcctgggccatgtggccgctgcaggagccccacggtgcaagggtgaggatagcccaaggaagggctgggcatctgcccagacaggcctcccacagaaggctggtgaccaggtcccaggcgggcaagactcagccttggtggggcctgaggacagaggaggcccaggagcatcggggagagaggtggagggacaccgggagagccaggagcgtggacacagccagaactcatcacagaggctggcgtccagccccgggtcacgtgcagcaggaacaagcagccactctgggggcaccaggtggagaggcaagacgacaaagagggtgcccgtgttcttgtgaaagcggggctgctggccacgagtgctggacagaggcccccacactctgctgcccccatcacgccgttccgtgactgtcacgcagaatccgcagacaggaagggagactcgagcgggagtgcggccagcgcctgcctcagctgtcagggaggactcccgggctcactcgaaggaggtgccaccatttcagctttggtagcttttcttcttcttttaaattttctaaagctcattaattgtctttgatgtttcttttgtgatgacaataaaatatcctttttaagtcttgt

SEQ ID NO: 990 - DNA, 1267 bp, Homo sapiens
cttccaccaagggcccatcggtcttccccctggcgccctgctccaggagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacacctgcaacgtgaatcacaagcccagcaacaccaaggtggacaagagagttgagctcaaaaccccacttggtgacacaactcacacatgcccacggtgcccagagcccaaatcttgtgacacacctcccccgtgcccacggtgcccagagcccaaatcttgtgacacacctcccccatgcccacggtgcccagagcccaaatcttgtgacacacctcccccatgcccacggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgcgggaggagcagttcaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccgtggagtgggagagcagcgggcagccggagaacaactacaacaccacgcctcccatgctggactccgacggctccttcttcctctacagcaagctcaccgtggacaagagcaggtggcagcaggggaacatcttctcatgctccgtgatgcatgaggctctgcacaaccgcttcacgcagaagagcctctccctgtctccgggtaaatgagtgcgacggccggcaagcccccgctccccgggctctcggggtcgcgcgaggatgcttggcacgtaccccgtgtacatacttcccgggcacccagcatggaaataaagcacccagcgctgccctgggcccctgcg

SEQ ID NO: 991 - DNA, 1235 bp, Homo sapiens
tattgagaggctgagaccacgggcagaatggtcataatcactgccagtatcagtccagccccagggactcagagacagagaaaagagcagtgaacaaggtccgggctccccaccttctcccacgacctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccggctgtcctacagtcctcaggactctactccctcagcagcgtggtgaccgtgacctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcatggaggtgcataatgccaagacaaagccacgggaggagcagttcaacagcacgttccgtgtggtcagcgtcctcaccgtcgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgagtgccacggccggcaagcccccgctccccaggctctcggggtcgcgtgaggatgcttggcacgtaccccgtgtacatacttcccaggcacccagcatgggaaataaagcacccagcgctgccctgggccc

SEQ ID NO: 992 - DNA, 2617 bp, Homo sapiens
cctccaccaagggcccatcggtcttccccctggcaccctcctccaagagcacctctgggggcacagcagccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccggagctgcaactggaggagagctgtgcggaggcgcaggacggggagctggacgggctgtggacgaccatcaccatcttcatcacactcttcctgttaagcgtgtgctacagtgccaccgtcaccttcttcaaggtgaagtggatcttctcctcggtggtggacctgaagcagaccatcatccccgactacaggaacatgatcggacagggggcctagggccaccctctgcggggtgtccagggccgcccagaccccacacaccagccatgggccatgctcagccaccacccaggccacacctgcccccgacctcaccgccctcaaccccatggctctctggcctcgcagttgccctctgaccctgacacacctgacacgccccccttccagaccctgtgcatagcaggtctaccccagacctccgctgcttggtgcatgcagggcactgggggccaggtgtcccctcagcaggacgtccttgccctccggaccacaaggtgctcacacaaaaggaggcagtgaccggtatcccaggcccccacccaggcaggagctggccctggagccaaccccgtccacgccagcctcctgaacacaggcgtggtttccagatggtgagtgggagcatcagccgccaaggtagggaagccacagcaccatcaggccctgttggggaggcttccgagagctgcgaaggctcactcagacggccttcctcccagcccgcagccagccagcctccattccgggcactcccgtgaactcctgacatgaggaatgacgttgttctgatttcaagcaaagaacgctgctctctggctcctgggaacagtctcggtgccagcaccaccccttggctgcctgcccacactgctggattctcgggtggaactggacccgcagggacagccagccccagagtccgcactggggagagaaggggccaggcccaggacactgccacctcccacccactccagtccaccgagatcactcagagaagagcctgggccatgtggccgctgcaggagccccacagtgcaagggtgaggatagcccaaggaagggctgggcatctgcccagacaggcctcccagagaaggctggtgaccaggtcccaggcgggcaagactcagccttggtggggcctgaggacagaggaggcccaggagcatcggggagagaggtggagggacaccgggagagccaggagcgtggacacagccagaactcatcacagaggctggcgtccagccccgggtcacgtgcagcaggaacaagcagccactctgggggcaccaggtggagaggcaagacgacaaagagggtgcccgtgttcttgcgaaagcagggctgctggccacgagtgctggacagaggcccccacgctctgctgcccccatcacgccgttccgtgactgtcacgcagaatctgcagacaggaagggagactcgagcgggagtgcggccagcgcctgcctcggccgtcagggaggactcctgggctcactcgaaggaggtgccaccatttcagctttggtagcttttcttcttcttttaaattttctaaagctcattaattgtctttgatgtttcttttgtgatgacaataaaatatcctttttaagtcttgt

SEQ ID NO: 993 - DNA, 855 bp, Homo sapiens
gtgcgttcttctacacatgcgcagggttgggcgggtcttcttccttctcgcctaacgctgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctggagttaggaggcagattgatagtaggattataataaacattaaataatca

SEQ ID NO: 994 - DNA, 707 bp, Homo sapiens
cacctaacgccaccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccgccaaaagtatgtccaacaagcctggcagaaggcagacatcaatacaaaatgggcagccacacgatgggccaagaagattgaagccagagaaaggaaagccaagatgacagattttgatcgttttaaagttatgaaggcaaagaaaacgaggaacagaataatcaagaatgaagttaagaagcttcaaaaggcagctctcctgaaagcttctcccaaaaaagcacctggtactaagggtactgctgctgctgctgctgctgctgctgctgctaaagttccagcaaaaaagatgacggccgcgagtaaaaaggcttcagcccagaaggttcctgcccagaaagccacaggccagaaagcagcacctgctccaaaagctcagaagggtcaaaaagctccagcccagaaagcacctgctccaaaggcatctggcaagaaagcataagtggcaatcataaaaagtaataaaggttctttttgacctgtt

SEQ ID NO: 995 - DNA, 701 bp, Homo sapiens
gccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgaaaaaaaaaa

SEQ ID NO: 996 - DNA, 926 bp, Homo sapiens
gcacccagaattctaactaggatcttcaagaacaactctccccaggtcagtgcatggagcagaaagagaagggaaagggatagaatgtcttcatgactttaatcctagtatttgaaaaaaaataatcaaaccttgcacctacaaatttctgtcttgatccagaaagtcattagcataaaaaagataatagtggccttctcacctaacgccaccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccgccaaaagtatgtccaacaagcctggcagaaggcagacatcaatacaaaatgggcagccacacgatgggccaagaagattgaagccagagaaaggaaagccaagatgacagattttgatcgttttaaagttatgaaggcaaagaaaacgaggaacagaataatcaagaatgaagttaagaagcttcaaaaggcagctctcctgaaagcttctcccaaaaaagcacctggtactaagggtactgctgctgctgctgctgctgctgctaaagttccagcaaaaaagatgacggccgcgagtaaaaaggcttcagcccagaaggttcctgcccagaaagccacaggccagaaagcagcacctgctccaaaagctcagaagggtcaaaaagctccagcccagaaagcacctgctccaaaggcatctggcaagaaagcataagtggcaatcataaaaagtaataaaggttctttttgacctgttggcaaatgtaaaaaaaaaaaaaaaag

SEQ ID NO: 997 - DNA, 1172 bp, Homo sapiens
ggtgagtcttactgttgcgggctccggggccgtcgaccatgccgctcgacctccacctccgctgggaagctgaggcgccgaacggctcccagagggtcccgggaagcgcatggtgagggtccccgggccggctgtgcagcggaatcgggcccttcccggactcgcgcccttcccggactcgccgctggcgagcgcgtggagggcccggcaggcctggcgcgccttgggccacgcgtgcgcgcctccgccgctggagctggatggctgatgcggctcgtggtccgagagccttgtcctgccgtgtgggccttgcggacctgggagctggtgggcgttgggaaccgggcttaagctactgaggcgtttgctgatttcgtccatccaggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctggagttaggaggcagattgatagtaggattataataaacattaaataatca

SEQ ID NO: 998 - DNA, 435 bp, Homo sapiens
atgatgttcaagcacttcctggaggtttgccaggtggcctatgtctcctttggaccttatgctggaaagctggtcgcagttgtagatgttactgatgaaaacagggctctggctgatggactttgcactcaggtaatgggacaggccgtgtctttcaaatgcatgcagctcactgacttcatcctcaagttcccacatagcacccaccaaaggaagcttcgaaaggcagctctcctgaaagcttctaccagaaaagcacctgctgctaaagtcccagcaaaaaagatgatcactgcgggcaagaaggctccagcccggaagattcctgcccagaaagccacaggccagaaggcagcacttcttcagaaagctcagaagggtcaaaaagtgttggcccagggagcaccttctccaaaagtgtctggcaaggaagca

SEQ ID NO: 999 - DNA, 3170 bp, Homo sapiens
ggctggcccaggctacggcggctgcagggctccggcaaccgctccggcaacgccaaccgctccgctgcgcgcaggctgggctgcaggctctcggctgcagcgctgggtgtcttcaggcctatggagagcagcttgcgtgggctgggcctgcagtacctggtttgcatagatgattggcaggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacctgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcggggtagaaatgcattttattctttaagttcacgtaagatacaagtttcagacagggtctgaaggactggattggccaaacatcagacctgtcttccaaggagaccaagtcctggctacatcccagcctgtggttacagtgcagacaggccatgtgagccaccgctgccagcacagagcgtccttccccctgtagactagtgccgtagggagtacctgctgccccagctgactgtggccccctccgtgatccatccatctccagggagcaagacagagacgcaggaatggaaagcggagttcctaacaggatgaaagttcccccatcagttcccccagtacctccaagcaagtagctttccacatttgtcacagaaatcagaggagagatggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctccttatgacgcggctcaaaaggaaaccaagtggtcaggagttgtttctgacccactgatctctactaccacaaggaaaatagtttaggagaaaccagcttttactgtttttgaaaaattacagcttcaccctgtcaagttaacaaggaatgcctgtgccaataaaaggtttctccaacttgaagtctactctgatgggatctcagatcctttgtcactgcctatagacttgtagctgctgtctctctttgtccctgcagagaatcacgtcctggaactgcatgttcttgcgactcttgggacttcatcttaacttctcgctgccccagccatgttttcaaccatggcatccctcccccaattagttccctgtcatcctcgtcaaccttctctgtaagtgcctggtaagcttgcccttgcttaagaactcaaaacatagctgtgctctatttttttgttgttgttgtgactgacagagtgagattccgtctcccaggctggagtgcagtggcgccttctcagctcactgcaacctgcagcctcctagattcaagcgattctcctgcttcagccttccgagtagctgggatgacaggcactcaccaatatgcctgggtaatttttgtatttttaagtacatacaggatttcaccatgttggccaggctagtttcaaactcccggcctcaggtggtctgcctgcctcagcctcccaaagtgttgggattacaggtgtgagccactgggccctgcctgtactttttatcagccacaaatccagcaacaagctgaggattcagctcataaaacaggtttggtgtcttggtgatctcacataaccaagatgctaccccgtggggaaccacatccccctggatgccctccagccttggtttgggctggagtcagggcctgtatacagtattttgaatttgtatgccactggtttgcattgctggtcaggaactctagtgctttgcatagccctggtttagaaacatgttatagcagttcttggtatagagcaaactagaagaaccagcaatcattccactgtcctgccaaggtacacctcagtactccccttcccaactgaagtggtatgaggctagctctttccaaaagcattcaagtttggcttctgatgtgactcagaatttaggaaccagatgctagatcaaataagctctgaaaatctgaggaacattgtaggaaaggtttgttaagcatctcttaagtgccatgatgagcataacagccggccgtggtggctcacgcctgtaatcccagcactttgggaggccaaggtgggaggatgacaag

SEQ ID NO: 1000 - DNA, 3190 bp, Homo sapiens
acggcggctgcagggctccggcaaccgctccggcaacgccaaccgctccgctgcgcgcaggctgggctgcaggctctcggctgcagcgctggggtcttgctttgtctcccaggctggtgtgcagtggtgcgaccacggctcacggcagcctcagccacccagatgtaagcgatctggttcccacctcagcctcccgagtagtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacctgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcggggtagaaatgcattttattctttaagttcacgtaagatacaagtttcagacagggtctgaaggactggattggccaaacatcagacctgtcttccaaggagaccaagtcctggctacatcccagcctgtggttacagtgcagacaggccatgtgagccaccgctgccagcacagagcgtccttccccctgtagactagtgccgtagggagtacctgctgccccagctgactgtggccccctccgtgatccatccatctccagggagcaagacagagacgcaggaatggaaagcggagttcctaacaggatgaaagttcccccatcagttcccccagtacctccaagcaagtagctttccacatttgtcacagaaatcagaggagagatggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctccttatgacgcggctcaaaaggaaaccaagtggtcaggagttgtttctgacccactgatctctactaccacaaggaaaatagtttaggagaaaccagcttttactgtttttgaaaaattacagcttcaccctgtcaagttaacaaggaatgcctgtgccaataaaaggtttctccaacttgaagtctactctgatgggatctcagatcctttgtcactgcctatagacttgtagctgctgtctctctttgtccctgcagagaatcacgtcctggaactgcatgttcttgcgactcttgggacttcatcttaacttctcgctgccccagccatgttttcaaccatggcatccctcccccaattagttccctgtcatcctcgtcaaccttctctgtaagtgcctggtaagcttgcccttgcttaagaactcaaaacatagctgtgctctatttttttgttgttgttgtgactgacagagtgagattccgtctcccaggctggagtgcagtggcgccttctcagctcactgcaacctgcagcctcctagattcaagcgattctcctgcttcagccttccgagtagctgggatgacaggcactcaccaatatgcctgggtaatttttgtatttttaagtacatacaggatttcaccatgttggccaggctagtttcaaactcccggcctcaggtggtctgcctgcctcagcctcccaaagtgttgggattacaggtgtgagccactgggccctgcctgtactttttatcagccacaaatccagcaacaagctgaggattcagctcataaaacaggtttggtgtcttggtgatctcacataaccaagatgctaccccgtggggaaccacatccccctggatgccctccagccttggtttgggctggagtcagggcctgtatacagtattttgaatttgtatgccactggtttgcattgctggtcaggaactctagtgctttgcatagccctggtttagaaacatgttatagcagttcttggtatagagcaaactagaagaaccagcaatcattccactgtcctgccaaggtacacctcagtactccccttcccaactgaagtggtatgaggctagctctttccaaaagcattcaagtttggcttctgatgtgactcagaatttaggaaccagatgctagatcaaataagctctgaaaatctgaggaacattgtaggaaaggtttgttaagcatctcttaagtgccatgatgagcataacagccggccgtggtggctcacgcctgtaatcccagcactttgggaggccaaggtgggaggatgacaag

SEQ ID NO: 1001 - DNA, 1978 bp, Homo sapiens
gggagggtacttagggccggggctggcccaggctacggcggctgcagggctccggcaaccgctccggcaacgccaaccgctccgctgcgcgcaggctgggctgcaggctctcggctgcagcgctgggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcggggtagaaatgcattttattctttaagttcacgtaagatacaagtttcagacagggtctgaaggactggattggccaaacatcagacctgtcttccaaggagaccaagtcctggctacatcccagcctgtggttacagtgcagacaggccatgtgagccaccgctgccagcacagagcgtccttccccctgtagactagtgccgtagggagtacctgctgccccagctgactgtggccccctccgtgatccatccatctccagggagcaagacagagacgcaggaatggaaagcggagttcctaacaggatgaaagttcccccatcagttcccccagtacctccaagcaagtagctttccacatttgtcacagaaatcagaggagagatggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctcctaatgacgcggctcaaaaggaaaccaagtggtcaggagttgtttctgacccactgatctctactaccacaaggaaaatagtttaggagaaaccagcttttactgtttttgaaaaattacagcttcaccctgtcaagttaacaaggaatgcctgtgccaataaaagttttctccaacttgaa

SEQ ID NO: 1002 - DNA, 2002 bp, Homo sapiens
aattccgcggcaaccgctccggcaacgccaaccgctccgctgcgcgcaggctgggctgcaggctctcggctgcagcgctgggctggtgtgcagtggtgcgaccacggctcacggcagcctcagccacccagatgtaagcgatctggttcccacctcagccttccgagtagtggatctaggatctggcttccaacatgtggcagctctgggcctccctctgctgcctgctggtgttggccaatgcccggagcaggccctctttccatcccgtgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccgcatctgcatccacaccaatgcgcacgtcagcgtggaggtgtcggcggaggacctgctcacctgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgcggaatcgaatcagaagtggtggctggaattccacgcaccgatcagtactgggaaaagatctaatctgccgtgggcctgtcgtgccagtcctgggggcgagatcggggtagaaagtcattttattctttaagttcacgtaagatacaagtttcaggcagggtctgaaggactggattggccaaagtcctccaaggagaccaagtcctggctacatcccagcctgtggttacagtgcagacaggccatgtgagccaccgctgccagcacagagcgtccttccccctgtagactagtgccgtgggagtacctgctgcccagctgctgtggccccctccgtgatccatccatctccagggagcaagacagagacgcaggatggaaagcggagttcctaacaggatgaaagttcccccatcagttcccccagtacctccaagcaagtagctttccacatttgtcacagaaatcagaggagagatggtgttgggagccctttggagaacgccagtctccaggtccccctgcatctatcgagtttgcaatgtcacaacctctctgatcttgtgctcagcatgattctttaatagaagttttatttttcgtgcactctgctaatcatgtgggtgagccagtggaacagcgggagcctgtgctggtttgcagattgcctcctaatgacgcggctcaaaaggaaaccaagtggtcaggagttgtttctgacccactgatctctactaccacaaggaaaatagtttaggagaaaccagcttttactgtttttgaaaaattacagcttcaccctgtcaagttaacaaggaatgcctgtgccaataaaaggtttctccaacttg

SEQ ID NO: 1003 - DNA, 2988 bp, Homo sapiens
acttagggccggggctggcccaggctacggcggcaaccgctccggcaacgccaaccgctccgctgcgcgcaggctgggctgcaggctctcggctgcagcgctgggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacctgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcgggagaatcacgtcctggaactgcatgttcttgcgactcttgggacttcatcttaacttctcgctgccccagccatgttttcaaccatggcatccctcccccaattagttccctgtcatcctcgtcaaccttctctgtaagtgcctggtaagcttgcccttgcttaagaactcaaaacatagctgtgctctatttttttgttgttgttgtgactgacagagtgagattccgtctcccaggctggagtgcagtggcgccttctcagctcactgcaacctgcagcctcctagattcaagcgattctcctgcttcagccttccgagtagctgggatgacaggcactcaccaatatgcctgggtaatttttgtatttttaagtacatacaggatttcaccatgttggccaggctagtttcaaactcccggcctcaggtggtctgcctgcctcagcctcccaaagtgttgggattacaggtgtgagccactgggccctgcctgtactttttatcagccacaaatccagcaacaagctgaggattcagctcataaaacaggtttggtgtcttggtgatctcacataaccaagatgctaccccgtggggaaccacatccccctggatgccctccagccttggtttgggctggagtcagggcctgtatacagtattttgaatttgtatgccactggtttgcattgctggtcaggaactctagtgctttgcatagccctggtttagaaacatgttatagcagttcttggtatagagcaaactagaagaaccagcaatcattccactgtcctgccaaggtacacctcagtactccccttcccaactgaagtggtatgaggctagctctttccaaaagcattcaagtttggcttctgatgtgactcagaatttaggaaccagatgctagatcaaataagctctgaaaatctgaggaacattgtaggaaaggtttgttaagcatctcttaagtgccatgatgagcataacagccggccgtggtggctcacgcctgtaatcccagcactttgggaggccaaggtgggaggatgacaaggtcaggagttttgagatcagccttggcaacacggtgaaaccccatctctactaaaaatacaaaattagccaagcatgctggcacatgcctgtaatcccagctactcgggaggctgaggtacgagaatcgcttgaacctgggaggcagaggatgcagtgagccgagatcacgccattgcactccagcctgggggacaagagtgaatctgtgtctcaccaaaaaaaaaaagaaaaagaaagatgcttaacaaaggttaccataagccacaaattcataaccacttatccttccagtttcaagtagaatatattcataacctcaataaagttctccctgctcccaaactgagttgattcattccatgcgcactgtctccctcacctccatcgtatacgcacctgcagctccttgcctgcttctagcatggagccagcggggatgtgctggtgagtgacaaggaattgtggggcatgtcgacatcagcttaaggctttgttagaaacacctgccttgcagtgtttgtgactgggaaagagctcagtgttttaatacacctcagatcaccacattgatcataactttgtcacctcagttcaatagtttctcctggattcttgtccaagtgagatgacaggtggacgtaacaatgccttttcagtctttacctagactctccagagaatcactccagaatagaaattagagtataggtaggcagtccaacctctgcattt

SEQ ID NO: 1004 - DNA, 4001 bp, Homo sapiens
tagggccggggctggcccaggctacggcggctgcagggctccggcaaccgctccggcaacgccaaccgctccgctgcgcgcaggctgggctgcaggctctcggctgcagcgctgggctggtgtgcagtggtgcgaccacggctcacggcagcctcagccacccagatgtaagcgatctggttcccacctcagcctcccgagtagtgtcttcaggcctatggagagcagcttgcgtgggctgggcctgcagtacctggtttgcatagatgattggcaggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacctgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcggggtagaaatgcattttattctttaagttcacgtaagatacaagtttcagacagggtctgaaggactggattggccaaacatcagacctgtcttccaaggagaccaagtcctggctacatcccagcctgtggttacagtgcagacaggccatgtgagccaccgctgccagcacagagcgtccttccccctgtagactagtgccgtagggagtacctgctgccccagctgactgtggccccctccgtgatccatccatctccagggagcaagacagagacgcaggaatggaaagcggagttcctaacaggatgaaagttcccccatcagttcccccagtacctccaagcaagtagctttccacatttgtcacagaaatcagaggagagatggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctccttatgacgcggctcaaaaggaaaccaagtggtcaggagttgtttctgacccactgatctctactaccacaaggaaaatagtttaggagaaaccagcttttactgtttttgaaaaattacagcttcaccctgtcaagttaacaaggaatgcctgtgccaataaaaggtttctccaacttgaagtctactctgatgggatctcagatcctttgtcactgcctatagacttgtagctgctgtctctctttgtccctgcagagaatcacgtcctggaactgcatgttcttgcgactcttgggacttcatcttaacttctcgctgccccagccatgttttcaaccatggcatccctcccccaattagttccctgtcatcctcgtcaaccttctctgtaagtgcctggtaagcttgcccttgcttaagaactcaaaacatagctgtgctctatttttttgttgttgttgtgactgacagagtgagattccgtctcccaggctggagtgcagtggcgccttctcagctcactgcaacctgcagcctcctagattcaagcgattctcctgcttcagccttccgagtagctgggatgacaggcactcaccaatatgcctgggtaatttttgtatttttaagtacatacaggatttcaccatgttggccaggctagtttcaaactcccggcctcaggtggtctgcctgcctcagcctcccaaagtgttgggattacaggtgtgagccactgggccctgcctgtactttttatcagccacaaatccagcaacaagctgaggattcagctcataaaacaggtttggtgtcttggtgatctcacataaccaagatgctaccccgtggggaaccacatccccctggatgccctccagccttggtttgggctggagtcagggcctgtatacagtattttgaatttgtatgccactggtttgcattgctggtcaggaactctagtgctttgcatagccctggtttagaaacatgttatagcagttcttggtatagagcaaactagaagaaccagcaatcattccactgtcctgccaaggtacacctcagtactccccttcccaactgaagtggtatgaggctagctctttccaaaagcattcaagtttggcttctgatgtgactcagaatttaggaaccagatgctagatcaaataagctctgaaaatctgaggaacattgtaggaaaggtttgttaagcatctcttaagtgccatgatgagcataacagccggccgtggtggctcacgcctgtaatcccagcactttgggaggccaaggtgggaggatgacaaggtcaggagttttgagatcagccttggcaacacggtgaaaccccatctctactaaaaatacaaaattagccaagcatgctggcacatgcctgtaatcccagctactcgggaggctgaggtacgagaatcgcttgaacctgggaggcagaggatgcagtgagccgagatcacgccattgcactccagcctgggggacaagagtgaatctgtgtctcaccaaaaaaaaaaagaaaaagaaagatgcttaacaaaggttaccataagccacaaattcataaccacttatccttccagtttcaagtagaatatattcataacctcaataaagttctccctgctcccaaactgagttgattcattccatgcgcactgtctccctcacctccatcgtatacgcacctgcagctccttgcctgcttctagcatggagccagcggggatgtgctggtgagtgacaaggaattgtggggcatgtcgacatcagcttaaggctttgttagaaacacctgccttgcagtgtttgtgactgggaaagagctcagtgttttaatacacctcagatcaccacattgatcataactttgtcacctcagttcaatagtttctcctggattcttgtccaagtgagatgacaggtggacgtaacaatgccttttcagtctttacctagactctccagagaatcactccagaatagaaattagagtataggtaggcagtccaacctctgcattt

SEQ ID NO: 1005 - DNA, 3193 bp, Homo sapiens
tagggccggggctggcccaggctacggcggctgcagggctccggcaaccgctccggcaacgccaaccgctccgctgcgcgcaggctgggctgcaggctctcggctgcagcgctgggctggtgtgcagtggtgcgaccacggctcacggcagcctcagccacccagatgtaagcgatctggttcccacctcagcctcccgagtagtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacctgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcggggtagaaatgcattttattctttaagttcacgtaagatacaagtttcagacagggtctgaaggactggattggccaaacatcagacctgtcttccaaggagaccaagtcctggctacatcccagcctgtggttacagtgcagacaggccatgtgagccaccgctgccagcacagagcgtccttccccctgtagactagtgccgtagggagtacctgctgccccagctgactgtggccccctccgtgatccatccatctccagggagcaagacagagacgcaggaatggaaagcggagttcctaacaggatgaaagttcccccatcagttcccccagtacctccaagcaagtagctttccacatttgtcacagaaatcagaggagagatggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctccttatgacgcggctcaaaaggaaaccaagtggtcaggagttgtttctgacccactgatctctactaccacaaggaaaatagtttaggagaaaccagcttttactgtttttgaaaaattacagcttcaccctgtcaagttaacaaggaatgcctgtgccaataaaaggtttctccaacttgaagtctactctgatgggatctcagatcctttgtcactgcctatagacttgtagctgctgtctctctttgtccctgcagagaatcacgtcctggaactgcatgttcttgcgactcttgggacttcatcttaacttctcgctgccccagccatgttttcaaccatggcatccctcccccaattagttccctgtcatcctcgtcaaccttctctgtaagtgcctggtaagcttgcccttgcttaagaactcaaaacatagctgtgctctatttttttgttgttgttgtgactgacagagtgagattccgtctcccaggctggagtgcagtggcgccttctcagctcactgcaacctgcagcctcctagattcaagcgattctcctgcttcagccttccgagtagctgggatgacaggcactcaccaatatgcctgggtaatttttgtatttttaagtacatacaggatttcaccatgttggccaggctagtttcaaactcccggcctcaggtggtctgcctgcctcagcctcccaaagtgttgggattacaggtgtgagccactgggccctgcctgtactttttatcagccacaaatccagcaacaagctgaggattcagctcataaaacaggtttggtgtcttggtgatctcacataaccaagatgctaccccgtggggaaccacatccccctggatgccctccagccttggtttgggctggagtcagggcctgtatacagtattttgaatttgtatgccactggtttgcattgctggtcaggaactctagtgctttgcatagccctggtttagaaacatgttatagcagttcttggtatagagcaaactagaagaaccagcaatcattccactgtcctgccaaggtacacctcagtactccccttcccaactgaagtggtatgaggctagctctttccaaaagcattcaagtttggcttctgatgtgactcagaatttaggaaccagatgctagatcaaataagctctgaaaatctgaggaacattgtaggaaaggtttgttaagcatctcttaagtgccatgatgagcataacagccggccgtggtggctcacgcctgtaatcccagcactttgggaggccaaggtgggaggatgacaag

SEQ ID NO: 1006 - DNA, 3039 bp, Homo sapiens
cggcaaccgctccggcaacgccaaccgctccgctgcgcgcaggctgggctgcaggctctcggctgcagcgctggatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacctgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcggggtagaaatgcattttattctttaagttcacgtaagatacaagtttcagacagggtctgaaggactggattggccaaacatcagacctgtcttccaaggagaccaagtcctggctacatcccagcctgtggttacagtgcagacaggccatgtgagccaccgctgccagcacagagcgtccttccccctgtagactagtgccgtagggagtacctgctgccccagctgactgtggccccctccgtgatccatccatctccagggagcaagacagagacgcaggaatggaaagcggagttcctaacaggatgaaagttcccccatcagttcccccagtacctccaagcaagtagctttccacatttgtcacagaaatcagaggagagatggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctccttatgacgcggctcaaaaggaaaccaagtggtcaggagttgtttctgacccactgatctctactaccacaaggaaaatagtttaggagaaaccagcttttactgtttttgaaaaattacagcttcaccctgtcaagttaacaaggaatgcctgtgccaataaaaggtttctccaacttgaagtctactctgatgggatctcagatcctttgtcactgcctatagacttgtagctgctgtctctctttgtccctgcagagaatcacgtcctggaactgcatgttcttgcgactcttgggacttcatcttaacttctcgctgccccagccatgttttcaaccatggcatccctcccccaattagttccctgtcatcctcgtcaaccttctctgtaagtgcctggtaagcttgcccttgcttaagaactcaaaacatagctgtgctctatttttttgttgttgttgtgactgacagagtgagattccgtctcccaggctggagtgcagtggcgccttctcagctcactgcaacctgcagcctcctagattcaagcgattctcctgcttcagccttccgagtagctgggatgacaggcactcaccaatatgcctgggtaatttttgtatttttaagtacatacaggatttcaccatgttggccaggctagtttcaaactcccggcctcaggtggtctgcctgcctcagcctcccaaagtgttgggattacaggtgtgagccactgggccctgcctgtactttttatcagccacaaatccagcaacaagctgaggattcagctcataaaacaggtttggtgtcttggtgatctcacataaccaagatgctaccccgtggggaaccacatccccctggatgccctccagccttggtttgggctggagtcagggcctgtatacagtattttgaatttgtatgccactggtttgcattgctggtcaggaactctagtgctttgcatagccctggtttagaaacatgttatagcagttcttggtatagagcaaactagaagaaccagcaatcattccactgtcctgccaaggtacacctcagtactccccttcccaactgaagtggtatgaggctagctctttccaaaagcattcaagtttggcttctgatgtgactcagaatttaggaaccagatgctagatcaaataagctctgaaaatctgaggaacattgtaggaaaggtttgttaagcatctcttaagtgccatgatgagcataacagccggccgtggtggctcacgcctgtaatcccagcactttgggaggccaaggtgggaggatgacaag

SEQ ID NO: 1007 - DNA, 3267 bp, Homo sapiens
tagggccggggctggcccaggctacggcggctgcagggctccggcaaccgctccggcaacgccaaccgctccgctgcgcgcaggctgggctgcaggctctcggctgcagcgctgggctggtgtgcagtggtgcgaccacggctcacggcagcctcagccacccagatgtaagcgatctggttcccacctcagcctcccgagtagtgtcttcaggcctatggagagcagcttgcgtgggctgggcctgcagtacctggtttgcatagatgattggcaggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacctgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcggggtagaaatgcattttattctttaagttcacgtaagatacaagtttcagacagggtctgaaggactggattggccaaacatcagacctgtcttccaaggagaccaagtcctggctacatcccagcctgtggttacagtgcagacaggccatgtgagccaccgctgccagcacagagcgtccttccccctgtagactagtgccgtagggagtacctgctgccccagctgactgtggccccctccgtgatccatccatctccagggagcaagacagagacgcaggaatggaaagcggagttcctaacaggatgaaagttcccccatcagttcccccagtacctccaagcaagtagctttccacatttgtcacagaaatcagaggagagatggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctccttatgacgcggctcaaaaggaaaccaagtggtcaggagttgtttctgacccactgatctctactaccacaaggaaaatagtttaggagaaaccagcttttactgtttttgaaaaattacagcttcaccctgtcaagttaacaaggaatgcctgtgccaataaaaggtttctccaacttgaagtctactctgatgggatctcagatcctttgtcactgcctatagacttgtagctgctgtctctctttgtccctgcagagaatcacgtcctggaactgcatgttcttgcgactcttgggacttcatcttaacttctcgctgccccagccatgttttcaaccatggcatccctcccccaattagttccctgtcatcctcgtcaaccttctctgtaagtgcctggtaagcttgcccttgcttaagaactcaaaacatagctgtgctctatttttttgttgttgttgtgactgacagagtgagattccgtctcccaggctggagtgcagtggcgccttctcagctcactgcaacctgcagcctcctagattcaagcgattctcctgcttcagccttccgagtagctgggatgacaggcactcaccaatatgcctgggtaatttttgtatttttaagtacatacaggatttcaccatgttggccaggctagtttcaaactcccggcctcaggtggtctgcctgcctcagcctcccaaagtgttgggattacaggtgtgagccactgggccctgcctgtactttttatcagccacaaatccagcaacaagctgaggattcagctcataaaacaggtttggtgtcttggtgatctcacataaccaagatgctaccccgtggggaaccacatccccctggatgccctccagccttggtttgggctggagtcagggcctgtatacagtattttgaatttgtatgccactggtttgcattgctggtcaggaactctagtgctttgcatagccctggtttagaaacatgttatagcagttcttggtatagagcaaactagaagaaccagcaatcattccactgtcctgccaaggtacacctcagtactccccttcccaactgaagtggtatgaggctagctctttccaaaagcattcaagtttggcttctgatgtgactcagaatttaggaaccagatgctagatcaaataagctctgaaaatctgaggaacattgtaggaaaggtttgttaagcatctcttaagtgccatgatgagcataacagccggccgtggtggctcacgcctgtaatcccagcactttgggaggccaaggtgggaggatgacaag

SEQ ID NO: 1008 - DNA, 1522 bp, Homo sapiens
ccaggtgcccgcgcgggccggtgcgccgggggcgggcccggctcaggtaaaggcgcggctgggccggaggccgaggctgcgctgcacccagctccccgcgatcacatccagtcggccagggcccaggggccaggttcttctgtatacaaggagaaagtattctctctcaaacagtaaactcccttttatcacagagcaggctccaggctcaaagccctaggatctaccatacccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaagagttatttataccaaatcctacaggggattgtgttttgtcactctagaagagttcttcacagagacttaaaacctcaaaatctcttgattgatgacaaaggaacaattaaactggctgattttggccttgccagagcttttggaatacctatcagagtatatacacatgaggcaataacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatgtcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggtttaaatgttctcatcagtttcttgccatgttgttaactatacaa

SEQ ID NO: 1009 - DNA, 1351 bp, Homo sapiens
ccaggtgcccgcgcgggccggtgcgccgggggcgggcccggctcaggtaaaggcgcggctgggccggaggccgaggctgcgctgcacccagctccccgcgatcacatccagtcggccagggcccaggggccaggttcttctgtatacaaggagaaagtattctctctcaaacagtaaactcccttttatcacagagcaggctccaggctcaaagccctaggatctaccatacccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaaggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatgtcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggtttaaatgttctcatcagtttcttgccatgttgttaactatacaa

SEQ ID NO: 1010 - DNA, 1852 bp, Homo sapiens
ccaggtgcccgcgcgggccggtgcgccgggggcgggcccggctcaggtaaaggcgcggctgggccggaggccgaggctgcgctgcacccagctccccgcgatcacatccagtcggccagggcccaggggccaggttcttctgtatacaaggagaaagtattctctctcaaacagtaaactcccttttatcacagagcaggctccaggctcaaagccctaggatctaccatacccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaagagttatttataccaaatcctacaggggattgtgttttgtcactctagaagagttcttcacagagacttaaaacctcaaaatctcttgattgatgacaaaggaacaattaaactggctgattttggccttgccagagcttttggaatacctatcagagtatatacacatgaggcaaagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatgtcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggaggtgcttatcttggctttcgagtctgagtttaaaactacacattttgacatagtgtttattagcagccatctaaaaaggctctaatgtatatttaactaaaattactagctttgggaattaaactgtttaacaa

SEQ ID NO: 1011 - DNA, 1841 bp, Homo sapiens
ccaggtgcccgcgcgggccggtgcgccgggggcgggcccggctcaggtaaaggcgcggctgggccggaggccgaggctgcgctgcacccagctccccgcgatcacatccagtcggccagggcccaggggccaggttcttctgtatacaaggagaaagtattctctctcaaacagtaaactcccttttatcacagagcaggctccaggctcaaagccctaggatctaccatacccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaaggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatgtcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggaggtgcttatcttggctttcgagtctgagtttaaaactacacattttgacatagtgtttattagcagccatctaaaaaggctctaatgtatatttaactaaaattactagctttgggaattaaactgtttaacaa

SEQ ID NO: 1012 - DNA, 2012 bp, Homo sapiens
ccaggtgcccgcgcgggccggtgcgccgggggcgggcccggctcaggtaaaggcgcggctgggccggaggccgaggctgcgctgcacccagctccccgcgatcacatccagtcggccagggcccaggggccaggttcttctgtatacaaggagaaagtattctctctcaaacagtaaactcccttttatcacagagcaggctccaggctcaaagccctaggatctaccatacccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaagagttatttataccaaatcctacaggggattgtgttttgtcactctagaagagttcttcacagagacttaaaacctcaaaatctcttgattgatgacaaaggaacaattaaactggctgattttggccttgccagagcttttggaatacctatcagagtatatacacatgaggcaataacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatgtcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggaggtgcttatcttggctttcgagtctgagtttaaaactacacattttgacatagtgtttattagcagccatctaaaaaggctctaatgtatatttaactaaaattactagctttgggaattaaactgtttaacaa

SEQ ID NO: 1013 - DNA, 4839 bp, Homo sapiens
ggaggcggcgggaggcgggcggaggaggaggcggaggaggcgggagctgagctgagtggggcgggcggcggcggggcccgagccggagaagatggcggtgcggaagaaggacggcggccccaacgtgaagtactacgaggccgcggacaccgtgacccagttcgacaacgtgcggctgtggctcggcaagaactacaagaagtatatacaagctgaaccacccaccaacaagtccctgtctagcctggttgtacagttgctacaatttcaggaagaagtttttggcaaacatgtcagcaatgcaccgctcactaaactgccgatcaaatgtttcctagatttcaaagcgggaggctccttgtgccacattcttgcagctgcctacaaattcaagagtgaccagggatggcggcgttacgatttccagaatccatcacgcatggaccgcaatgtggaaatgtttatgaccattgagaagtccttggtgcagaataattgcctgtctcgacctaacatttttctgtgcccagaaattgagcccaaactactagggaaattaaaggacattatcaagagacaccagggaacagtcactgaggataagaacaatgcctcccatgttgtgtatcctgtcccggggaatctagaagaagaggaatgggtacgaccagtcatgaagagggataagcaggttcttctgcactggggctactatcctgacagttacgacacgtggatcccagcgagtgaaattgaggcatctgtggaagatgctccaactcctgagaaacctaggaaggttcatgcaaagtggatcctggacaccgacaccttcaatgaatggatgaatgaggaagactatgaagtaaatgatgacaaaaaccctgtctcccgccgaaagaagatttcagccaagacactgacagatgaggtgaacagcccagattcagatcgacgggacaagaaggggggaaactataagaagaggaagcgctccccctctccttcaccaaccccagaagcaaagaagaaaaatgctaagaaaggtccctcaacaccttacactaagtcaaagcgtggccacagagaagaggagcaagaagacctgacaaaggacatggacgagccctcaccagtccccaatgtagaagaggtgacacttcccaaaacagtcaacacaaagaaagactcagagtcggccccagtcaaaggcggcaccatgaccgacctggatgaacaggaagatgaaagcatggagacgacgggcaaggatgaggatgagaacagtacggggaacaagggagagcagaccaagaatccagacctgcatgaggacaatgtgactgaacagacccaccacatcatcattcccagctacgctgcctggtttgactacaatagtgttcatgccattgagcggagggctctccccgagttcttcaacggcaagaacaagtccaagactccagagatctacctggcctatcgaaactttatgattgacacttaccgactgaacccccaagagtatcttacctctaccgcctgccgccgaaacctagcgggtgatgtctgtgccatcatgagggtccatgccttcctagaacagtggggtcttattaactaccaggtggatgctgagagtcgaccaaccccaatggggcctccgcctacctctcacttccatgtcttggctgacacaccatcagggctggtgcctctgcagcccaagacacctcagcagacctctgcttcccaacaaatgctcaactttcctgacaaaggcaaagagaaaccaacagacatgcaaaactttgggctgcgcacagacatgtacacaaaaaagaatgttccctccaagagcaaggctgcagccagtgccactcgtgagtggacagaacaggaaaccctgcttctcctggaggcactggaaatgtacaaagatgactggaacaaagtgtccgagcatgtgggaagccgcacacaggacgagtgcatcttgcattttcttcgtcttcccattgaagacccatacctggaggactcagaggcctccctaggccccctggcctaccaacccatccccttcagtcagtcgggcaaccctgttatgagcactgttgccttcctggcctctgtcgtcgatccccgagtcgcctctgctgctgcaaagtcagccctagaggagttctccaaaatgaaggaagaggtacccacggccttggtggaggcccatgttcgaaaagtggaagaagcagccaaagtaacaggcaaggcggaccctgccttcggtctggaaagcagtggcattgcaggaaccacctctgatgagcctgagcggattgaggagagcgggaatgacgaggctcgggtggaaggccaggccacagatgagaagaaggagcccaaggaaccccgagaaggagggggtgctatagaggaggaagcaaaagagaaaaccagcgaggctcccaagaaggatgaggagaaagggaaagaaggcgacagtgagaaggagtccgagaagagtgatggagacccaatagtcgatcctgagaaggagaaggagccaaaggaagggcaggaggaagtgctgaaggaagtggtggagtctgagggggaaaggaagacaaaggtggagcgggacattggcgagggcaacctctccaccgctgctgccgccgccctggccgccgccgcagtgaaagctaagcacttggctgctgttgaggaaaggaagatcaaatctttggtggccctgctggtggagacccagatgaaaaagttggagatcaaacttcggcactttgaggagctggagactatcatggaccgggagcgagaagcactggagtatcagaggcagcagctcctggccgacagacaagccttccacatggagcagctgaagtatgcggagatgagggctcggcagcagcacttccaacagatgcaccaacagcagcagcagccaccaccagccctgcccccaggctcccagcctatccccccaacaggggctgctgggccacccgcagtccatggcttggctgtggctccagcctctgtagtccctgctcctgctggcagtggggcccctccaggaagtttgggcccttctgaacagattgggcaggcagggtcaactgcagggccacagcagcagcaaccagctggagccccccagcctggggcagtcccaccaggggttcccccccctggaccccatggcccctcaccgttccccaaccaacaaactcctccctcaatgatgccaggggcagtgccaggcagcgggcacccaggcgtggcgggtaatgctcctttgggtttgccttttggcatgccgcctcctcctcctcctcctgctccatccatcatcccatttggtagtctagctgactccatcagtattaacctccccgctcctcctaacctgcatgggcatcaccaccatctcccgttcgccccgggcactctccccccacctaacctgcctgtgtccatggcgaaccctctacatcctaacctgccggcgaccaccaccatgccatcttccttgcctctcgggccggggctcggatccgccgcagcccaaagccctgccattgtggcagctgttcagggcaacctcctgcccagtgccagcccactgccagacccaggcacccccctgcctccagaccccacagccccgagcccaggcacggtcacccctgtgccacctccacagtgaggagccagccagacatctctccccctcaccccctgtggacatcacggttccaggaacagcccttcccccaccactgggaccctccccagcctggagagttcatcactacgtaaggaaagctccttccgcccctccaaagccctcaccatgcctaacagaggcatgcatttttatatcagattattcaaggacttctgtttaaaagatgtttataatgtctgggagagaggataggatgggaatgctgccctaaaggaagggctggtgaaaggtgtttatacaaggttctattaaccacttctaagggtacacctccctccaaactactgcattttctatggattaaaaaaaaaaaaaaaaagtagattttaaaaagccacattggagctcccttctacccactaaaaaataaccaatttttacattttttgagggggagtgagttttaggaaaggggaattaagattccagggagagctctggggatagaacagggcgcagattccatctctccccaagcccctttttagtgactaagtcaaggccccaactcccctcccccaccctacgctgagcttattcgagttcattcgtactaataatccctcctgcggcttcctcattgttgctgttttaggccaccccagctcagccaatgattcctttccctctgaatgtcagttttgtttttaaaagtcacttgcttagttgatgtcagcgtatgtgtatttggtggggaaaacctaatttcggggatttctgtggtaggtaataggagaagaaagggcactgggggctgttctccttccttccctgggctgtatccatggactcctggaaggcacagagaagggagctataagaggatgtgaagttttaaaacctgaaattgttttttaaagcacttaagcacctccatattatgggaaggcaggtgtgactccaggctctgcactggttcttcttggttcctcccaccaggccctttgttcctcatgtccccatgtttctctccctctgcgtcttagcacctttcttctgttcaaagttttctgtaaattttctctttttttctttctttcttttttttttttttataaatt

SEQ ID NO: 1014 - DNA, 5750 bp, Homo sapiens
gctgggcggggccgggaagcggcagtggcggctacgcgcgcgggggtgcgcgcgggaacgaccgggaaacaccgcgagggccggggtgggccaggctgtggggacgacgggctgcgacgatggccgcagcggcgggcggcggcgggccggggacagcggtaggcgccacgggctcggggattgcggcggcagccgcaggcctagctgtttatcgacggaaggatgggggcccggccaccaagttttgggagagcccggagacggtgtcccagctggattcggtgcgggtctggctgggcaagcactacaagaagtatgttcatgcggatgctcctaccaataaaacactggctgggctggtggtgcagcttcttcagttccaggaagatgcctttgggaagcatgtcaccaacccggccttcaccaaactccctgcaaagtgtttcatggatttcaaagctggaggcgccttatgtcacattcttggggctgcttacaagtataaaaatgaacagggatggcggaggtttgacctacagaacccatctcgaatggatcgtaatgtggaaatgtttatgaacattgaaaaaacattggtgcagaacaattgtttgaccagacccaacatctacctcattccagacattgatctgaagttggctaacaaattgaaagatatcatcaaacgacatcagggaacatttacggatgagaagtcaaaagcttcccaccacatttacccatattcttcctcacaagacgatgaagaatggttgagaccggtgatgagaaaagagaagcaagtgttagtgcattggggcttttacccagacagctatgatacttgggtccatagtaatgatgttgatgctgaaattgaagatccaccaattccagaaaaaccatggaaggttcatgtgaaatggattttggacactgatattttcaatgaatggatgaatgaggaggattatgaggtggatgaaaataggaagcctgtgagttttcgtcagcggatttcaaccaagaatgaagagccagtcagaagtccagaaagaagagatagaaaagcatcagctaatgctcgaaagaggaaacattcgccttcgcctccccctccgacaccaacagaatcacggaagaagagtgggaagaaaggccaagctagcctttatgggaagcgcagaagtcagaaagaggaagatgagcaagaagatctaaccaaggatatggaagacccaacacctgtacccaatatagaagaagtagtacttcccaaaaatgtgaacctaaagaaagatagtgaaaatacacctgttaaaggaggaactgtagcggatctagatgagcaggatgaagaaacagtcacagcaggaggaaaggaagatgaagatcctgccaaaggtgatcagagtcgatcagttgaccttggggaagataatgtgacagagcagaccaatcacattattattcctagttatgcatcatggtttgattataactgtattcatgtgattgaacggcgtgctcttcctgagttcttcaatggaaaaaacaaatccaagactccagaaatatacttggcatatcgaaattttatgattgacacgtatcgtctaaacccccaagagtatttaactagcactgcttgtcggaggaacttgactggagatgtgtgtgctgtgatgagggtccatgccgggggagagcagtggggactcgttaattaccaagttgacccggaaagtagacccatggcaatgggacctcctcctactcctcattttaatgtattagctgataccccctctgggcttgtgcctctgcatcttcgatcacctcaggttcctgctgctcaacagatgctaaattttcctgagaaaaacaaggaaaaaccagttgatttgcagaactttggtctccgtactgacatttactccaagaaaacattagcaaagagtaaaggtgctagtgctggaagagaatggactgaacaggagacccttctactcctggaggccctggagatgtacaaggatgattggaacaaagtgtcggaacatgttggaagtcgtactcaggatgaatgcatcctccactttttgagacttcccattgaggacccataccttgagaattcagatgcttcccttgggcctttggcctaccagcctgtccccttcagtcagtcaggaaatccagttatgagtactgttgcttttttggcatctgtggtggaccctcgcgtggcatctgctgcagcaaaagcggctttggaggagttttctcgggtccgggaggaggtaccactggaattggttgaagctcatgtcaagaaagtacaagaagcagcacgagcctctgggaaagtggatcccacctacggtctggagagcagctgcattgcaggcacagggcccgatgagccagagaagcttgaaggagctgaagaggaaaaaatggaagccgaccctgatggtcagcagcctgaaaaggcagaaaataaagtggaaaatgaaacggatgaaggtgataaagcacaagatggagaaaatgaaaaaaatagtgaaaaggaacaggatagtgaagtgagtgaggataccaaatcagaagaaaaggagactgaagagaacaaagaactcactgatacatgtaaagaaagagaaagtgatactgggaagaagaaagtagaacatgaaatttccgaaggaaatgttgccacagccgcagcagctgctcttgcctcagcggctaccaaagccaagcacctggctgcagtggaagaaagaaagatcaagtccctggtagctctcttggttgagacacaaatgaagaaactagagatcaaacttcgacattttgaagagctggaaactatcatggacagagagaaagaagctctagaacaacagaggcagcagttgcttactgaacgccaaaacttccacatggaacagctgaagtatgctgaattacgagcacgacagcaaatggaacagcagcagcatggccagaaccctcaacaggcacaccagcactcaggaggacctggcctggccccacttggagcagcagggcaccctggcatgatgcctcatcaacagccccctccctaccctctgatgcaccaccagatgccaccacctcatccaccccagccaggtcagataccaggcccaggttccatgatgcccgggcagcacatgccaggccgcatgattcccactgttgcagccaacatccacccctctgggagtggccctacccctcctggcatgccaccaatgccaggaaacatcttaggaccccgggtacccctgacagcacctaacggcatgtatccccctccaccacagcagcagccaccgccaccaccacctgcagatggggtccctccgcctcctgctcctggcccgccagcctcagctgctccttagcctggaagatgcagggaacctccacgcccaccaccatgagctggagtggggatgacaagacttgtgttcctcaactttcttgggtttctttcaggatttttcttctcacagctccaagcacgtgtcccgtgcctccccactcctcttaccacccctctctctgacactttttgtgttgggtcctcagccaacactcaaggggaaacctgtagtgacagtgtgccctggtcatccttaaaataacctgcatctcccctgtcctggtgtgggagtaagctgacagtttctctgcaggtcctgtcaactttagcatgctatgtctttaccatttttgctctcttgcagttttttgctttgtcttatgcttctatggataatgctatataatcattatctttttatctttctgttattattgttttaaaggagagcatcctaagttaataggaaccaaaaaataatgatgggcagaagggggggaatagccacaggggacaaaccttaaggcattataagtgaccttatttctgcttttctgagctaagaatggtgctgatggtaaagtttgagacttttgccacacacaaatttgtgaaaattaaacgagatgtggaaggagaacctcagtgattttattccctagtgaggcctctgagggcctccacactgcctggcagaacataccactgaactagtatgtgctagaggagggcacaaacatccgctccttccctaggcctgctggctctggttttctatgcagatgattcattggattgggggtgagtgttttgtttttctgggggcagtgtgagctttgagggttggaatattgggaggcattccttagtttcctcaactagcctggaaagttaggagtctagggtaattaccccccaatgagtctagcctactattcactgctttgtgtgcatttttttctccctctttaaaaaaccctttaaaagaaaaaaaaaagtagatagtgctaaatattttagctcatgaaacttggttaggatggctgggggtacaagtccccaaactacctcttgttacagtagccagggagtggaatttcgtcaaccggtacttttaaggttaggatgggacgggaaaagtgaagcaggatattagctccttataccttctcccttccatttctgagatctcacattccatctatcacagggttttcaaagagatgctgagggtaacaaggaactcacttggcagtcagagcatcatgctttgaggtttggggtgctcaggctgggagggtagaatgccattccagaggacaagccacaaaaatgccttaatttgagctcgtatttacccctgctgataagtgacttgagagttcccggttttttcctcttgtccttccctcccttctgtccttccatgtgtggggaaagggtgtttttggtagagcttggtttccaaagcgcctggctttctcacttcacattctcaagtggcagtttcattatttagaatgcaaggtggacatcttttggatatctttttctatatattttctaaagctttacatatgagagggtatagggaggtgtttataaaacacttgagaacttttttccttaatatcagaaagcaaaaaaataaaaccacaattgagatttgcctttcaaaccctcaggtttgcctctaaccaggtgtccctggtcaccatcagagtactggaatacgggaaccgaggagaccttggtccttttgtttttgttctggactcttgggagtggaaatgagaatgagtttattctcactggagcttagttccaatgcatttggctccagaaagaccccagtgccttttgacaatggccagggttttacctacttcctgccagtctttcccaaaggaaactcattccaaatacttcttttttcccctggagtccgagaaggaaaatggaattctggttcatactgtggtcccttgtaacctcaggtctttaatgtgatcactttcaaatttaaaagatccaggtggaaatatttttactatagtaataattctacaaaatacctgaattcttaacactgttatatttcagtataagtggtggctttttcttttcatgtctttgatctggttttattcctgtaattcagccacctgattttgtgaggggggggaataatatgtggtttttgtacaaacatgtttctcagtgtgttgttattttggaaaaaatgaggggagggagtttggcaagaatggagaaaatgaatgaagaaggcctaatctctctctttttcagtgaataaatggaacaccatttc

SEQ ID NO: 1015 - DNA, 6144 bp, Homo sapiens
gctgggcggggccgggaagcggcagtggcggctacgcgcgcgggggtgcgcgcgggaacgaccgggaaacaccgcgagggccggggtgggccaggctgtggggacgacgggctgcgacgatggccgcagcggcgggcggcggcgggccggggacagcggtaggcgccacgggctcggggattgcggcggcagccgcaggcctagctgtttatcgacggaaggatgggggcccggccaccaagttttgggagagcccggagacggtgtcccagctggattcggtgcgggtctggctgggcaagcactacaagaagtatgttcatgcggatgctcctaccaataaaacactggctgggctggtggtgcagcttcttcagttccaggaagatgcctttgggaagcatgtcaccaacccggccttcaccaaactccctgcaaagtgtttcatggatttcaaagctggaggcgccttatgtcacattcttggggctgcttacaagtataaaaatgaacagggatggcggaggtttgacctacagaacccatctcgaatggatcgtaatgtggaaatgtttatgaacattgaaaaaacattggtgcagaacaattgtttgaccagacccaacatctacctcattccagacattgatctgaagttggctaacaaattgaaagatatcatcaaacgacatcagaagaatggttgagaccggtgatgagaaaagagaagcaagtgttagtgcattggggcttttacccagacagctatgatacttgggtccatagtaatgatgttgatgctgaaattgaagatccaccaattccagaaaaaccatggaaggttcatgtgaaatggattttggacactgatattttcaatgaatggatgaatgaggaggattatgaggtggatgaaaataggaagcctgtgagttttcgtcagcggatttcaaccaagaatgaagagccagtcagaagtccagaaagaagagatagaaaagcatcagctaatgctcgaaagaggaaacattcgccttcgcctccccctccgacaccaacagaatcacggaagaagagtgggaagaaaggccaagctagcctttatgggaagcgcagaagtcagaaagaggaagatgagcaagaagatctaaccaaggatatggaagacccaacacctgtacccaatatagaagaagtagtacttcccaaaaatgtgaacctaaagaaagatagtgaaaatacacctgttaaaggaggaactgtagcggatctagatgagcaggatgaagaaacagtcacagcaggaggaaaggaagatgaagatcctgccaaaggtgatcagagtcgatcagttgaccttggggaagataatgtgacagagcagaccaatcacattattattcctagttatgcatcatggtttgattataactgtattcatgtgattgaacggcgtgctcttcctgagttcttcaatggaaaaaacaaatccaagactccagaaatatacttggcatatcgaaattttatgattgacacgtatcgtctaaacccccaagagtatttaactagcactgcttgtcggaggaacttgactggagatgtgtgtgctgtgatgagggtccatgcctttttagagcagtggggactcgttaattaccaagttgacccggaaagtagacccatggcaatgggacctcctcctactcctcattttaatgtattagctgataccccctctgggcttgtgcctctgcatcttcgatcacctcaggttcctgctgctcaacagatgctaaattttcctgagaaaaacaaggaaaaaccagttgatttgcagaactttggtctccgtactgacatttactccaagaaaacattagcaaagagtaaaggtgctagtgctggaagagaatggactgaacaggagacccttctactcctggaggccctggagatgtacaaggatgattggaacaaagtgtcggaacatgttggaagtcgtactcaggatgaatgcatcctccactttttgagacttcccattgaggacccataccttgagaattcagatgcttcccttgggcctttggcctaccagcctgtccccttcagtcagtcaggaaatccagttatgagtactgttgcttttttggcatctgtggtggaccctcgcgtggcatctgctgcagcaaaagcggctttggaggagttttctcgggtccgggaggaggtaccactggaattggttgaagctcatgtcaagaaagtacaagaagcagcacgagcctctgggaaagtggatcccacctacggtctggagagcagctgcattgcaggcacagggcccgatgagccagagaagcttgaaggagctgaagaggaaaaaatggaagccgaccctgatggtcagcagcctgaaaaggcagaaaataaagtggaaaatgaaacggatgaaggtgataaagcacaagatggagaaaatgaaaaaaatagtgaaaaggaacaggatagtgaagtgagtgaggataccaaatcagaagaaaaggagactgaagagaacaaagaactcactgatacatgtaaagaaagagaaagtgatactgggaagaagaaagtagaacatgaaatttccgaaggaaatgttgccacagccgcagcagctgctcttgcctcagcggctaccaaagccaagcacctggctgcagtggaagaaagaaagatcaagtccctggtagctctcttggttgagacacaaatgaagaaactagagatcaaacttcgacattttgaagagctggaaactatcatggacagagagaaagaagctctagaacaacagaggcagcagttgcttactgaacgccaaaacttccacatggaacagctgaagtatgctgaattacgagcacgacagcaaatggaacagcagcagcatggccagaaccctcaacaggcacaccagcactcaggaggacctggcctggccccacttggagcagcagggcaccctggcatgatgcctcatcaacagccccctccctaccctctgatgcaccaccagatgccaccacctcatccaccccagccaggtcagataccaggcccaggttccatgatgcccgggcagcacatgccaggccgcatgattcccactgttgcagccaacatccacccctctgggagtggccctacccctcctggcatgccaccaatgccaggaaacatcttaggaccccgggtacccctgacagcacctaacggcatgtatccccctccaccacagcagcagccaccgccaccaccacctgcagatggggtccctccgcctcctgctcctggcccgccagcctcagctgctccttagcctggaagatgcagggaacctccacgcccaccaccatgagctggagtggggatgacaagacttgtgttcctcaactttcttgggtttctttcaggatttttcttctcacagctccaagcacgtgtcccgtgcctccccactcctcttaccacccctctctctgacactttttgtgttgggtcctcagccaacactcaaggggaaacctgtagtgacagtgtgccctggtcatccttaaaataacctgcatctcccctgtcctggtgtgggagtaagctgacagtttctctgcaggtcctgtcaactttagcatgctatgtctttaccatttttgctctcttgcagttttttgctttgtcttatgcttctatggataatgctatataatcattatctttttatctttctgttattattgttttaaaggagagcatcctaagttaataggaaccaaaaaataatgatgggcagaagggggggaatagccacaggggacaaaccttaaggcattataagtgaccttatttctgcttttctgagctaagaatggtgctgatggtaaagtttgagacttttgccacacacaaatttgtgaaaattaaacgagatgtggaaggagaacctcagtgattttattccctagtgaggcctctgagggcctccacactgcctggcagaacataccactgaactagtatgtgctagaggagggcacaaacatccgctccttccctaggcctgctggctctggttttctatgcagatgattcattggattgggggtgagtgttttgtttttctgggggcagtgtgagctttgagggttggaatattgggaggcattccttagtttcctcaactagcctggaaagttaggagtctagggtaattaccccccaatgagtctagcctactattcactgctttgtgtgcatttttttctccctctttaaaaaaccctttaaaagaaaaaaaaaagtagatagtgctaaatattttagctcatgaaacttggttaggatggctgggggtacaagtccccaaactacctcttgttacagtagccagggagtggaatttcgtcaaccggtacttttaaggttaggatgggacgggaaaagtgaagcaggatattagctccttataccttctcccttccatttctgagatctcacattccatctatcacagggttttcaaagagatgctgagggtaacaaggaactcacttggcagtcagagcatcatgctttgaggtttggggtgctcaggctgggagggtagaatgccattccagaggacaagccacaaaaatgccttaatttgagctcgtatttacccctgctgataagtgacttgagagttcccggttttttcctcttgtccttccctcccttctgtccttccatgtgtggggaaagggtgtttttggtagagcttggtttccaaagcgcctggctttctcacttcacattctcaagtggcagtttcattatttagaatgcaaggtggacatcttttggatatctttttctatatattttctaaagctttacatatgagagggtatagggaggtgtttataaaacacttgagaacttttttccttaatatcagaaagcaaaaaaataaaaccacaattgagatttgcctttcaaaccctcaggtttgcctctaaccaggtgtccctggtcaccatcagagtactggaatacgggaaccgaggagaccttggtccttttgtttttgttctggactcttgggagtggaaatgagaatgagtttattcctactggagcttagttccaatgcatttggctccagaaagaccccagtgccttttgacaatggccagggttttacctacttcctgccagtctttcccaaaggaaactcattccaaatacttcttttttcccctggagtccgagaaggaaaatggaattctggttcatactgtggtcccttgtaacctcaggtctttaatgtgatcactttcaaatttaaaagatccaggtggaaatatttttactatagtaataattctacaaaatacctgaattcttaacactgttatatttcagtataagtggtggctttttcttttcatgtctttgatctggttttattcctgtaattcagccacctgattttgtgaggggggggaataatatgtggtttttgtacaaacatgtttctcagtgtgttgttattttggaaaaaatgaggggagggagtttggcaagaatggagaaaatgaatgaagaaggcctaatctctctctttttcagtgaataaatggaacaccatttctggattctagtcccattctctgcattcatacaccagtttcttcatatatcctatgaagaacctaaacatttggccccacctggtcttggtttgatcagcagttaaaattctgtgactcgggcttccttcccgactgcccaccttcatgatgtgtaaggaacatacattttgagggtacctcacccactgttcatttgcatggtcaaagtgaaaatgagtggaagttctccaaaaatgatggccaacatcctggcacctccaggtgtgagaaatagctttgcttggtgaatgggataatgtttgtcaggatgcagtttagacagtcccaagttggaggcaggccttgagggcagaagattctgtgaaccttgggggacagcttttgggtactcacagatataaaccctgtgcagaaaaaaagaagtgattgttttcaggatgcttataaatcgagtgaagcaaaa

SEQ ID NO: 1016 - DNA, 5391 bp, Homo sapiens
agacaaggtcttgctctgttacccaggctgcagtgcagtggcatgaagacagctcaagtgatcctccaacctcagcctccctgggggctggcactacgggcacgtgccacccatagctatgatacttgggtccatagtaatgatgttgatgctgaaattgaagatccaccaattccagaaaaaccatggaaggttcatgtgaaatggattttggacactgatattttcaatgaatggatgaatgaggaggattatgaggtggatgaaaataggaagcctgtgagttttcgtcagcggatttcaaccaagaatgaagagccagtcagaagtccagaaagaagagatagaaaagcatcagctaatgctcgaaagaggaaacattcgccttcgcctccccctccgacaccaacagaatcacggaagaagagtgggaagaaaggccaagctagcctttatgggaatgaacctaaagaaagatagtgaaaatacacctgttaaaggaggaactgtagcggatctagatgagcaggatgaagaaacagtcacagcaggaggaaaggaagatgaagatcctgccaaaggtgatcagagtcgatcagttgaccttggggaagataatgtgacagagcagaccaatcacattattattcctagttatgcatcatggtttgattataactgtattcatgtgattgaacggcgtgctcttcctgagttcttcaatggaaaaaacaaatccaagactccagaaatatacttggcatatcgaaattttatgattgacacgtatcgtctaaacccccaagagtatttaactagcactgcttgtcggaggaacttgactggagatgtgtgtgctgtgatgagggtccatgcctttttagagcagtggggactcgttaattaccaagttgacccggaaagtagacccatggcaatgggacctcctcctactcctcattttaatgtattagctgataccccctctgggcttgtgcctctgcatcttcgatcacctcaggttcctgctgctcaacagatgctaaattttcctgagaaaaacaaggaaaaaccagttgatttgcagaactttggtctccgtactgacatttactccaagaaaacattagcaaagagtaaaggtgctagtgctggaagagaatggactgaacaggagacccttctactcctggaggccctggagatgtacaaggatgattggaacaaagtgtcggaacatgttggaagtcgtactcaggatgaatgcatcctccactttttgagacttcccattgaggacccataccttgagaattcagatgcttcccttgggcctttggcctaccagcctgtccccttcagtcagtcaggaaatccagttatgagtactgttgcttttttggcatctgtggtggaccctcgcgtggcatctgctgcagcaaaagcggctttggaggagttttctcgggtccgggaggaggtaccactggaattggttgaagctcatgtcaagaaagtacaagaagcagcacgagcctctgggaaagtggatcccacctacggtctggagagcagctgcattgcaggcacagggcccgatgagccagagaagcttgaaggagctgaagaggaaaaaatggaagccgaccctgatggtcagcagcctgaaaaggcagaaaataaagtggaaaatgaaacggatgaaggtgataaagcacaagatggagaaaatgaaaaaaatagtgaaaaggaacaggatagtgaagtgagtgaggataccaaatcagaagaaaaggagactgaagagaacaaagaactcactgatacatgtaaagaaagagaaagtgatactgggaagaagaaagtagaacatgaaatttccgaaggaaatgttgccacagccgcagcagctgctcttgcctcagcggctaccaaagccaagcacctggctgcagtggaagaaagaaagatcaagtccctggtagctctcttggttgagacacaaatgaagaaactagagatcaaacttcgacattttgaagagctggaaactatcatggacagagagaaagaagctctagaacaacagaggcagcagttgcttactgaacgccaaaacttccacatggaacagctgaagtatgctgaattacgagcacgacagcaaatggaacagcagcagcatggccagaaccctcaacaggcacaccagcactcaggaggacctggcctggccccacttggagcagcagggcaccctggcatgatgcctcatcaacagccccctccctaccctctgatgcaccaccagatgccaccacctcatccaccccagccaggtcagataccaggcccaggttccatgatgcccgggcagcacatgccaggccgcatgattcccactgttgcagccaacatccacccctctgggagtggccctacccctcctggcatgccaccaatgccaggaaacatcttaggaccccgggtacccctgacagcacctaacggcatgtatccccctccaccacagcagcagccaccgccaccaccacctgcagatggggtccctccgcctcctgctcctggcccgccagcctcagctgctccttagcctggaagatgcagggaacctccacgcccaccaccatgagctggagtggggatgacaagacttgtgttcctcaactttcttgggtttctttcaggatttttcttctcacagctccaagcacgtgtcccgtgcctccccactcctcttaccacccctctctctgacactttttgtgttgggtcctcagccaacactcaaggggaaacctgtagtgacagtgtgccctggtcatccttaaaataacctgcatctcccctgtcctggtgtgggagtaagctgacagtttctctgcaggtcctgtcaactttagcatgctatgtctttaccatttttgctctcttgcagttttttgctttgtcttatgcttctatggataatgctatataatcattatctttttatctttctgttattattgttttaaaggagagcatcctaagttaataggaaccaaaaaataatgatgggcagaagggggggaatagccacaggggacaaaccttaaggcattataagtgaccttatttctgcttttctgagctaagaatggtgctgatggtaaagtttgagacttttgccacacacaaatttgtgaaaattaaacgagatgtggaaggagaacctcagtgattttattccctagtgaggcctctgagggcctccacactgcctggcagaacataccactgaactagtatgtgctagaggagggcacaaacatccgctccttccctaggcctgctggctctggttttctatgcagatgattcattggattgggggtgagtgttttgtttttctgggggcagtgtgagctttgagggttggaatattgggaggcattccttagtttcctcaactagcctggaaagttaggagtctagggtaattaccccccaatgagtctagcctactattcactgctttgtgtgcatttttttctccctctttaaaaaaccctttaaaagaaaaaaaaaagtagatagtgctaaatattttagctcatgaaacttggttaggatggctgggggtacaagtccccaaactacctcttgttacagtagccagggagtggaatttcgtcaaccggtacttttaaggttaggatgggacgggaaaagtgaagcaggatattagctccttataccttctcccttccatttctgagatctcacattccatctatcacagggttttcaaagagatgctgagggtaacaaggaactcacttggcagtcagagcatcatgctttgaggtttggggtgctcaggctgggagggtagaatgccattccagaggacaagccacaaaaatgccttaatttgagctcgtatttacccctgctgataagtgacttgagagttcccggttttttcctcttgtccttccctcccttctgtccttccatgtgtggggaaagggtgtttttggtagagcttggtttccaaagcgcctggctttctcacttcacattctcaagtggcagtttcattatttagaatgcaaggtggacatcttttggatatctttttctatatattttctaaagctttacatatgagagggtatagggaggtgtttataaaacacttgagaacttttttccttaatatcagaaagcaaaaaaataaaaccacaattgagatttgcctttcaaaccctcaggtttgcctctaaccaggtgtccctggtcaccatcagagtactggaatacgggaaccgaggagaccttggtccttttgtttttgttctggactcttgggagtggaaatgagaatgagtttattcctactggagcttagttccaatgcatttggctccagaaagaccccagtgccttttgacaatggccagggttttacctacttcctgccagtctttcccaaaggaaactcattccaaatacttcttttttcccctggagtccgagaaggaaaatggaattctggttcatactgtggtcccttgtaacctcaggtctttaatgtgatcactttcaaatttaaaagatccaggtggaaatatttttactatagtaataattctacaaaatacctgaattcttaacactgttatatttcagtataagtggtggctttttcttttcatgtctttgatctggttttattcctgtaattcagccacctgattttgtgaggggggggaataatatgtggtttttgtacaaacatgtttctcagtgtgttgttattttggaaaaaatgaggggagggagtttggcaagaatggagaaaatgaatgaagaaggcctaatctctctctttttcagtgaataaatggaacaccatttctggattctagtcccattctctgcattcatacaccagtttcttcatatatcctatgaagaacctaaacatttggccccacctggtcttggtttgatcagcagttaaaattctgtgactcgggcttccttcccgactgcccaccttcatgatgtgtaaggaacatacattttgagggtacctcacccactgttcatttgcatggtcaaagtgaaaatgagtggaagttctccaaaaatgatggccaacatcctggcacctccaggtgtgagaaatagctttgcttggtgaatgggataatgtttgtcaggatgcagtttagacagtcccaagttggaggcaggccttgagggcagaagattctgtgaaccttgggggacagcttttgggtactcacagatataaaccctgtgcagaaaaaaagaagtgattgttttcaggatgcttataaatcgagtgaagcaaaa

SEQ ID NO: 1017 - DNA, 5066 bp, Homo sapiens
ggaggcggcgggaggcgggcggaggaggaggcggaggaggcgggagctgagctgagtggggcgggcggcggcggggcccgagccggagaagatggcggtgcggaagaaggacggcggccccaacgtgaagtactacgaggccgcggacaccgtgacccagttcgacaacgtgcggctgtggctcggcaagaactacaagaagtatatacaagctgaaccacccaccaacaagtccctgtctagcctggttgtacagttgctacaatttcaggaagaagtttttggcaaacatgtcagcaatgcaccgctcactaaactgccgatcaaatgtttcctagatttcaaagcgggaggctccttgtgccacattcttgcagctgcctacaaattcaagagtgaccagggatggcggcgttacgatttccagaatccatcacgcatggaccgcaatgtggaaatgtttatgaccattgagaagtccttggtgcagaataattgcctgtctcgacctaacatttttctgtgcccagaaattgagcccaaactactagggaaattaaaggacattatcaagagacaccagggaacagtcactgaggataagaacaatgcctcccatgttgtgtatcctgtcccggggaatctagaagaagaggaatgggtacgaccagtcatgaagagggataagcaggttcttctgcactggggctactatcctgacagttacgacacgtggatcccagcgagtgaaattgaggcatctgtggaagatgctccaactcctgagaaacctaggaaggttcatgcaaagtggatcctggacaccgacaccttcaatgaatggatgaatgaggaagactatgaagtaaatgatgacaaaaaccctgtctcccgccgaaagaagatttcagccaagacactgacagatgaggtgaacagcccagattcagatcgacgggacaagaaggggggaaactataagaagaggaagcgctccccctctccttcaccaaccccagaagcaaagaagaaaaatgctaagaaaggtccctcaacaccttacactaagtcaaagcgtggccacagagaagaggagcaagaagacctgacaaaggacatggacgagccctcaccagtccccaatgtagaagaggtgacacttcccaaaacagtcaacacaaagaaagactcagagtcggccccagtcaaaggcggcaccatgaccgacctggatgaacaggaagatgaaagcatggagacgacgggcaaggatgaggatgagaacagtacggggaacaagggagagcagaccaagaatccagacctgcatgaggacaatgtgactgaacagacccaccacatcatcattcccagctacgctgcctggtttgactacaatagtgttcatgccattgagcggagggctctccccgagttcttcaacggcaagaacaagtccaagactccagagatctacctggcctatcgaaactttatgattgacacttaccgactgaacccccaagagtatcttacctctaccgcctgccgccgaaacctagcgggtgatgtctgtgccatcatgagggtccatgccttcctagaacagtggggtcttattaactaccaggtggatgctgagagtcgaccaaccccaatggggcctccgcctacctctcacttccatgtcttggctgacacaccatcagggctggtgcctctgcagcccaagacacctcagcagacctctgcttcccaacaaatgctcaactttcctgacaaaggcaaagagaaaccaacagacatgcaaaactttgggctgcgcacagacatgtacacaaaaaagaatgttccctccaagagcaaggctgcagccagtgccactcgtgagtggacagaacaggaaaccctgcttctcctggaggcactggaaatgtacaaagatgactggaacaaagtgtccgagcatgtgggaagccgcacacaggacgagtgcatcttgcattttcttcgtcttcccattgaagacccatacctggaggactcagaggcctccctaggccccctggcctaccaacccatccccttcagtcagtcgggcaaccctgttatgagcactgttgccttcctggcctctgtcgtcgatccccgagtcgcctctgctgctgcaaagtcagccctagaggagttctccaaaatgaaggaagaggtacccacggccttggtggaggcccatgttcgaaaagtggaagaagcagccaaagtaacaggcaaggcggaccctgccttcggtctggaaagcagtggcattgcaggaaccacctctgatgagcctgagcggattgaggagagcgggaatgacgaggctcgggtggaaggccaggccacagatgagaagaaggagcccaaggaaccccgagaaggagggggtgctatagaggaggaagcaaaagagaaaaccagcgaggctcccaagaaggatgaggagaaagggaaagaaggcgacagtgagaaggagtccgagaagagtgatggagacccaatagtcgatcctgagaaggagaaggagccaaaggaagggcaggaggaagtgctgaaggaagtggtggagtctgagggggaaaggaagacaaaggtggagcgggacattggcgagggcaacctctccaccgctgctgccgccgccctggccgccgccgcagtgaaagctaagcacttggctgctgttgaggaaaggaagatcaaatctttggtggccctgctggtggagacccagatgaaaaagttggagatcaaacttcggcactttgaggagctggagactatcatggaccgggagcgagaagcactggagtatcagaggcagcagctcctggccgacagacaagccttccacatggagcagctgaagtatgcggagatgagggctcggcagcagcacttccaacagatgcaccaacagcagcagcagccaccaccagccctgcccccaggctcccagcctatccccccaacaggggctgctgggccacccgcagtccatggcttggctgtggctccagcctctgtagtccctgctcctgctggcagtggggcccctccaggaagtttgggcccttctgaacagattgggcaggcagggtcaactgcagggccacagcagcagcaaccagctggagccccccagcctggggcagtcccaccaggggttcccccccctggaccccatggcccctcaccgttccccaaccaacaaactcctccctcaatgatgccaggggcagtgccaggcagcgggcacccaggcgtggcgggtaatgctcctttgggtttgccttttggcatgccgcctcctcctcctcctcctgctccatccatcatcccatttggtagtctagctgactccatcagtattaacctccccgctcctcctaacctgcatgggcatcaccaccatctcccgttcgccccgggcactctccccccacctaacctgcctgtgtccatggcgaaccctctacatcctaacctgccggcgaccaccaccatgccatcttccttgcctctcgggccggggctcggatccgccgcagcccaaagccctgccattgtggcagctgttcagggcaacctcctgcccagtgccagcccactgccagacccaggcacccccctgcctccagaccccacagccccgagcccaggcacggtcacccctgtgccacctccacagtgaggagccagccagacatctctccccctcaccccctgtggacatcacggttccaggaacagcccttcccccaccactgggaccctccccagcctggagagttcatcactacgtaaggaaagctccttccgcccctccaaagccctcaccatgcctaacagaggcatgcatttttatatcagattattcaaggacttctgtttaaaagatgtttataatgtctgggagagaggataggatgggaatgctgccctaaaggaagggctggtgaaaggtgtttatacaaggttctattaaccacttctaagggtacacctccctccaaactactgcattttctatggattaaaaaaaaaaaaaaaaagtagattttaaaaagccacattggagctcccttctacccactaaaaaataaccaatttttacattttttgagggggagtgagttttaggaaaggggaattaagattccagggagagctctggggatagaacagggcgcagattccatctctccccaagcccctttttagtgactaagtcaaggccccaactcccctcccccaccctacgctgagcttattcgagttcattcgtactaataatccctcctgcggcttcctcattgttgctgttttaggccaccccagctcagccaatgattcctttccctctgaatgtcagttttgtttttaaaagtcacttgcttagttgatgtcagcgtatgtgtatttggtggggaaaacctaatttcggggatttctgtggtaggtaataggagaagaaagggcactgggggctgttctccttccttccctgggctgtatccatggactcctggaaggcacagagaagggagctataagaggatgtgaagttttaaaacctgaaattgttttttaaagcacttaagcacctccatattatgacttggtgggtcaccccttagcttcctccctctcccaccaagactatgagaacttcagctgatagctgggggctccccagatgaggatgcagggatttgggagcagtggaagagggtgcccaaccttgggttggaccaacccttggctcgcagctcaactctgcttcccgcattcctgctccacgtgtcccagcttctcccctgtgacgggaaggcaggtgtgactccaggctctgcactggttcttcttggttcctcccaccaggccctttgttcctcatgtccccatgtttctctccctctgcgtcttagcacctttcttctgttcaaagttttctgtaaattttctctttttttctttctttcttttttttttttttataaattaatttgctttcagttcca

SEQ ID NO: 1018 - DNA, 3786 bp, Homo sapiens
ggcgggcggcggcggggcccgagccggagaagatggcggtgcggaagaaggacggcggccccaacgtgaagtactacgaggccgcggacaccgtgacccagttcgacaacgtgcggctgtggctcggcaagaactacaagaagtatatacaagctgaaccacccaccaacaagtccctgtctagcctggttgtacagttgctacaatttcaggaagaagtttttggcaaacatgtcagcaatgcaccgctcactaaactgccgatcaaatgtttcctagatttcaaagcgggaggctccttgtgccacattcttgcagctgcctacaaattcaagagtgaccagggatggcggcgttacgatttccagaatccatcacgcatggaccgcaatgtggaaatgtttatgaccattgagaagtccttggtgcagaataattgcctgtctcgacctaacatttttctgtgcccagaaattgagcccaaactactagggaaattaaaggacattatcaagagacaccagggaacagtcactgaggataagaacaatgcctcccatgttgtgtatcctgtcccggggaatctagaagaagaggaatgggtacgaccagtcatgaagagggataagcaggttcttctgcactggggctactatcctgacagttacgacacgtggatcccagcgagtgaaattgaggcatctgtggaagatgctccaactcctgagaaacctaggaaggttcatgcaaagtggatcctggacaccgacaccttcaatgaatggatgaatgaggaagactatgaagtaaatgatgacaaaaaccctgtctcccgccgaaagaagatttcagccaagacactgacagatgaggtgaacagcccagattcagatcgacgggacaagaaggggggaaactataagaagaggaagcgctccccctctccttcaccaaccccagaagcaaagaagaaaaatgctaagaaaggtccctcaacaccttacactaagtcaaagcgtggccacagagaagaggagcaagaagacctgacaaaggacatggacgagccctcaccagtccccaatgtagaagaggtgacacttcccaaaacagtcaacacaaagaaagactcagagtcggccccagtcaaaggcggcaccatgaccgacctggatgaacaggaagatgaaagcatggagacgacgggcaaggatgaggatgagaacagtacggggaacaagggagagcagaccaagaatccagacctgcatgaggacaatgtgactgaacagacccaccacatcatcattcccagctacgctgcctggtttgactacaatagtgttcatgccattgagcggagggctctccccgagttcttcaacggcaagaacaagtccaagactccagagatctacctggcctatcgaaactttatgattgacacttaccgactgaacccccaagagtatcttacctctaccgcctgccgccgaaacctagcgggtgatgtctgtgccatcatgagggtccatgccttcctagaacagtggggtcttattaactaccaggtggatgctgagagtcgaccaaccccaatggggcctccgcctacctctcacttccatgtcttggctgacacaccatcagggctggtgcctctgcagcccaagacacctcagggccgccaggttgatgctgataccaaggctgggcgaaagggcaaagagctggatgacctggtgccagagacggctaagggcaagccagagctgcagacctctgcttcccaacaaatgctcaactttcctgacaaaggcaaagagaaaccaacagacatgcaaaactttgggctgcgcacagacatgtacacaaaaaagaatgttccctccaagagcaaggctgcagccagtgccactcgtgagtggacagaacaggaaaccctgcttctcctggaggcactggaaatgtacaaagatgactggaacaaagtgtccgagcatgtgggaagccgcacacaggacgagtgcatcttgcattttcttcgtcttcccattgaagacccatacctggaggactcagaggcctccctaggccccctggcctaccaacccatccccttcagtcagtcgggcaaccctgttatgagcactgttgccttcctggcctctgtcgtcgatccccgagtcgcctctgctgctgcaaagtcagccctagaggagttctccaaaatgaaggaagaggtacccacggccttggtggaggcccatgttcgaaaagtggaagaagcagccaaagtaacaggcaaggcggaccctgccttcggtctggaaagcagtggcattgcaggaaccacctctgatgagcctgagcggattgaggagagcgggaatgacgaggctcgggtggaaggccaggccacagatgagaagaaggagcccaaggaaccccgagaaggagggggtgctatagaggaggaagcaaaagagaaaaccagcgaggctcccaagaaggatgaggagaaagggaaagaaggcgacagtgagaaggagtccgagaagagtgatggagacccaatagtcgatcctgagaaggagaaggagccaaaggaagggcaggaggaagtgctgaaggaagtggtggagtctgagggggaaaggaagacaaaggtggagcgggacattggcgagggcaacctctccaccgctgctgccgccgccctggccgccgccgcagtgaaagctaagcacttggctgctgttgaggaaaggaagatcaaatctttggtggccctgctggtggagacccagatgaaaaagttggagatcaaacttcggcactttgaggagctggagactatcatggaccgggagcgagaagcactggagtatcagaggcagcagctcctggccgacagacaagccttccacatggagcagctgaagtatgcggagatgagggctcggcagcagcacttccaacagatgcaccaacagcagcagcagccaccaccagccctgcccccaggctcccagcctatccccccaacaggggctgctgggccacccgcagtccatggcttggctgtggctccagcctctgtagtccctgctcctgctggcagtggggcccctccaggaagtttgggcccttctgaacagattgggcaggcagggtcaactgcagggccacagcagcagcaaccagctggagccccccagcctggggcagtcccaccaggggttcccccccctggaccccatggcccctcaccgttccccaaccaacaaactcctccctcaatgatgccaggggcagtgccaggcagcgggcacccaggcgtggcggacccaggcacccccctgcctccagaccccacagccccgagcccaggcacggtcacccctgtgccacctccacagtgaggagccagccagacatctctccccctcaccccctgtggacatcacggttccaggaacagcccttcccccaccactgggaccctccccagcctggagagttcatcactacgtaaggaaagctccttccgcccctccaaagccctcaccatgcctaacagaggcatgcatttttatatcagattattcaaggacttctgtttaaaagatgtttataatgtctgggagagaggataggatgggaatgctgccctaaaggaagggctggtgaaaggtgtttatacaaggttctattaaccacttctaagggtacacctccctccaaactactgcattttctatggattaaaaaaaaaaaaaaaaa

SEQ ID NO: 1019 - DNA, 4587 bp, Homo sapiens
ggaggcggcgggaggcgggcggaggaggaggcggaggaggcgggagctgagctgagtggggcgggcggcggcggggcccgagccggagaagatggcggtgcggaagaaggacggcggccccaacgtgaagtactacgaggccgcggacaccgtgacccagttcgacaacgtgcggctgtggctcggcaagaactacaagaagtatatacaagctgaaccacccaccaacaagtccctgtctagcctggttgtacagttgctacaatttcaggaagaagtttttggcaaacatgtcagcaatgcaccgctcactaaactgccgatcaaatgtttcctagatttcaaagcgggaggctccttgtgccacattcttgcagctgcctacaaattcaagagtgaccagggatggcggcgttacgatttccagaatccatcacgcatggaccgcaatgtggaaatgtttatgaccattgagaagtccttggtgcagaataattgcctgtctcgacctaacatttttctgtgcccagaaattgagcccaaactactagggaaattaaaggacattatcaagagacaccagggaacagtcactgaggataagaacaatgcctcccatgttgtgtatcctgtcccggggaatctagaagaagaggaatgggtacgaccagtcatgaagagggataagcaggttcttctgcactggggctactatcctgacagttacgacacgtggatcccagcgagtgaaattgaggcatctgtggaagatgctccaactcctgagaaacctaggaaggttcatgcaaagtggatcctggacaccgacaccttcaatgaatggatgaatgaggaagactatgaagtaaatgatgacaaaaaccctgtctcccgccgaaagaagatttcagccaagacactgacagatgaggtgaacagcccagattcagatcgacgggacaagaaggggggaaactataagaagaggaagcgctccccctctccttcaccaaccccagaagcaaagaagaaaaatgctaagaaaggtccctcaacaccttacactaagtcaaagcgtggccacagagaagaggagcaagaagacctgacaaaggacatggacgagccctcaccagtccccaatgtagaagaggtgacacttcccaaaacagtcaacacaaagaaagactcagagtcggccccagtcaaaggcggcaccatgaccgacctggatgaacaggaagatgaaagcatggagacgacgggcaaggatgaggatgagaacagtacggggaacaagggagagcagaccaagaatccagacctgcatgaggacaatgtgactgaacagacccaccacatcatcattcccagctacgctgcctggtttgactacaatagtgttcatgccattgagcggagggctctccccgagttcttcaacggcaagaacaagtccaagactccagagatctacctggcctatcgaaactttatgattgacacttaccgactgaacccccaagagtatcttacctctaccgcctgccgccgaaacctagcgggtgatgtctgtgccatcatgagggtccatgccttcctagaacagtggggtcttattaactaccaggtggatgctgagagtcgaccaaccccaatggggcctccgcctacctctcacttccatgtcttggctgacacaccatcagggctggtgcctctgcagcccaagacacctcagggccgccaggttgatgctgataccaaggctgggcgaaagggcaaagagctggatgacctggtgccagagacggctaagggcaagccagagctgcagacctctgcttcccaacaaatgctcaactttcctgacaaaggcaaagagaaaccaacagacatgcaaaactttgggctgcgcacagacatgtacacaaaaaagaatgttccctccaagagcaaggctgcagccagtgccactcgtgagtggacagaacaggaaaccctgcttctcctggaggcactggaaatgtacaaagatgactggaacaaagtgtccgagcatgtgggaagccgcacacaggacgagtgcatcttgcattttcttcgtcttcccattgaagacccatacctggaggactcagaggcctccctaggccccctggcctaccaacccatccccttcagtcagtcgggcaaccctgttatgagcactgttgccttcctggcctctgtcgtcgatccccgagtcgcctctgctgctgcaaagtcagccctagaggagttctccaaaatgaaggaagaggtacccacggccttggtggaggcccatgttcgaaaagtggaagaagcagccaaagtaacaggcaaggcggaccctgccttcggtctggaaagcagtggcattgcaggaaccacctctgatgagcctgagcggattgaggagagcgggaatgacgaggctcgggtggaaggccaggccacagatgagaagaaggagcccaaggaaccccgagaaggagggggtgctatagaggaggaagcaaaagagaaaaccagcgaggctcccaagaaggatgaggagaaagggaaagaaggcgacagtgagaaggagtccgagaagagtgatggagacccaatagtcgatcctgagaaggagaaggagccaaaggaagggcaggaggaagtgctgaaggaagtggtggagtctgagggggaaaggaagacaaaggtggagcgggacattggcgagggcaacctctccaccgctgctgccgccgccctggccgccgccgcagtgaaagctaagcacttggctgctgttgaggaaaggaagatcaaatctttggtggccctgctggtggagacccagatgaaaaagttggagatcaaacttcggcactttgaggagctggagactatcatggaccgggagcgagaagcactggagtatcagaggcagcagctcctggccgacagacaagccttccacatggagcagctgaagtatgcggagatgagggctcggcagcagcacttccaacagatgcaccaacagcagcagcagccaccaccagccctgcccccaggctcccagcctatccccccaacaggggctgctgggccacccgcagtccatggcttggctgtggctccagcctctgtagtccctgctcctgctggcagtggggcccctccaggaagtttgggcccttctgaacagattgggcaggcagggtcaactgcagggccacagcagcagcaaccagctggagccccccagcctggggcagtcccaccaggggttcccccccctggaccccatggcccctcaccgttccccaaccaacaaactcctccctcaatgatgccaggggcagtgccaggcagcgggcacccaggcgtggcggacccaggcacccccctgcctccagaccccacagccccgagcccaggcacggtcacccctgtgccacctccacagtgaggagccagccagacatctctccccctcaccccctgtggacatcacggttccaggaacagcccttcccccaccactgggaccctccccagcctggagagttcatcactacgtaaggaaagctccttccgcccctccaaagccctcaccatgcctaacagaggcatgcatttttatatcagattattcaaggacttctgtttaaaagatgtttataatgtctgggagagaggataggatgggaatgctgccctaaaggaagggctggtgaaaggtgtttatacaaggttctattaaccacttctaagggtacacctccctccaaactactgcattttctatggattaaaaaaaaaaaaaaaaagtagattttaaaaagccacattggagctcccttctacccactaaaaaataaccaatttttacattttttgagggggagtgagttttaggaaaggggaattaagattccagggagagctctggggatagaacagggcgcagattccatctctccccaagcccctttttagtgactaagtcaaggccccaactcccctcccccaccctacgctgagcttattcgagttcattcgtactaataatccctcctgcggcttcctcattgttgctgttttaggccaccccagctcagccaatgattcctttccctctgaatgtcagttttgtttttaaaagtcacttgcttagttgatgtcagcgtatgtgtatttggtggggaaaacctaatttcggggatttctgtggtaggtaataggagaagaaagggcactgggggctgttctccttccttccctgggctgtatccatggactcctggaaggcacagagaagggagctataagaggatgtgaagttttaaaacctgaaattgttttttaaagcacttaagcacctccatattatgggaaggcaggtgtgactccaggctctgcactggttcttcttggttcctcccaccaggccctttgttcctcatgtccccatgtttctctccctctgcgtcttagcacctttcttctgttcaaagttttctgtaaattttctctttttttctttctttcttttttttttttttataaatt

SEQ ID NO: 1020 - DNA, 2633 bp, Homo sapiens
tgcctctggctcctcagggcattcccggcggctccgggtttggcaacgaggacgggggagtgcgactgcgtctcgggcagcatggccgagaagcggcacacacgggactccgaagcccagcggctccccgactccttcaaggacagccccagtaagggccttggaccttgcggatggattttggtggcgttctcattcttattcaccgttataactttcccaatctcaatatggatgtgcataaagattataaaagagtatgaaagagccatcatctttagattgggtcgcattttacaaggaggagccaaaggacctggtttgttttttattctgccatgcactgacagcttcatcaaagtggacatgagaactatttcatttgatattcctcctcaggagatcctcacaaaggattcagtgacaattagcgtggatggtgtggtctattaccgcgttcagaatgcaaccctggctgtggcaaatatcaccaacgctgactcagcaacccgtcttttggcacaaactactctgaggaatgttctgggcaccaagaatctttctcagatcctctctgacagagaagaaattgcacacaacatgcagtctactctggatgatgccactgatgcctggggaataaaggtggagcgtgtggaaattaaggatgtgaaactacctgtgcagctccagagagctatggctgcagaagcagaagcgtcccgcgaggcccgcgccaaggttattgcagccgaaggagaaatgaatgcatccagggctctgaaagaagcctccatggtcatcactgaatctcctgcagcccttcagctccgatacctgcagacactgaccaccattgctgctgagaaaaactcaacaattgtcttccctctgcccatagatatgctgcaaggaatcataggggcaaaacacagccatctaggctagtgtagagatgagcgctagccttccaagcatgaagtcggggaccaaattagcctttaactcataaagagagggtagggcttttctttttccatatgtcaattgtggtgttcccagaatgtatagcagttataaaaataggtgaaagaattgttagcttgtaaatactgagagattggtgatttatataaggtaatctgttagtcttaaaatagttaaaagtttgtatttttagattattatgtagtaggttagatccctcttgttttgacttccactgactcattctgaaccccctaagcacccaggccagaggcaagaacctgggctgtaactgccacctgacaccgctgactggctaaatgctttgcagaaagtgatgaccttacaccacaaccagcttctccaggtcatatgtgccttacctccagagagtctttttttttttttttctgagatggagtttcactcttgttgcccaggctggagtgcaatagcatgatctcggctcactgcaacctccgcctcctgggttcaagagattctcctgcctcagcctccccagtagctgggattacaggctcatgccaccatgcccagctaatttttgtattattattattgttttttagtagagacggggtttcaccatgttggccaggctagtcacgaactcctaacctcaggtgatccacccacctctgcctcccaaagtgctgggattacaggcatgagctaccacacctggtttggagagtcttaattaaggaaatttccctaatgttcatttattttctaaatccagaccgtgtttcagaataatcctgaaaaagattactctaacccttaaaagacttttaaattcactactagagtggtcattttaaaaatacatccatgttttaacttatttgagccttctttatgagtaaatgattcctccttgttctgtctttcaaaccagctaaatatttgtcacaaaagtgcttttttctcactgttgcctattttcatatatcaggttttaaatagttttaattttttaataaaattttctctacgttctatatgcaattgttatatatctatttgaatagctgaaggactaaaatacttttttaagagataacttcaggaaaccattatattttactatctgcatgctgttaactgtggtacactgtgaaatatgttgattacaaacccattcattacatagtataaggaattcacagtatattgactatatagtgtctaatgatcttgggcagatactgtcaaacttacaatatctatatagatgtaggtctttttaaatttacctagtcattcttctatcatgtatattgatgctgaaagaggaactggtcagctcctctggacaacaaattcttagtctataatattaggagacatcttctgttttgcaaatgtctgtgaatctgagcaacctggcattctgcttactggccagaaagctggcgggtgacatttgtaacatttcctctttgagactctgagttcacctagagaagtctaagcataacagctttctttcccagcacgagcctttatagctctctttagctcaaccactctgtccatccagccaatggatgtcccttcccctgtaccccaatttcaagcttattttaggaagccttgaactaccatgtatcctggctcct

SEQ ID NO: 1021 - DNA, 919 bp, Homo sapiens
atggccgagaagcggcacacacgggactccgaagcccagcggctccccgactccttcaaggacagccccagtaagggccttggaccttgcggatggattttggtggcgttctcattcttattcaccgttataactttcccaatctcaatatggatgtgcataaagattataaaagagtatgaaagagccatcatctttagattgggtcgcattttacaaggaggagccaaaggacctggtttgttttttattctgccatgcactgacagcttcatcaaagtggacatgagaactatttcatttgatattcctcctcaggagatcctcacaaaggattcagtgacaattagcgtggatggtgtggtctattaccgcgttcagaatgcaaccctggctgtggcaaatatcaccaacgctgactcagcaacccgtcttttggcacaaactactctgaggaatgttctgggcaccaagaatctttctcagatcctctctgacagagaagaaattgcacacaacatgcagtctactctggatgatgccactgatgcctggggaataaaggtggagcgtgtggaaattaaagatgtgaaactacctgtgcagctccagagagctatggctgcagaagcagaagcgtcccgcgaggcccgcgccaaggttattgcagccgaaggagaaatgaatgcatccagggctctgaaagaagcctccatggtcatcactgaatctcctgcagcccttcagctccgatacctgcagacactgaccaccattgctgctgagaaaaactcaacaattgtcttccctctgcccatagatatgctgcaaggaatcataggggcaaaacacagccatctaggctagtgtagagatgagcgctagccttccaagcatgaagtcggggaccaaattagcg

SEQ ID NO: 1022 - DNA, 3142 bp, Homo sapiens
tgcctctggctcctcagggcattcccggcggctccgggtttggcaacgaggacgggggagtgcgactgcgtctcgggcagcatggccgagaagcggcacacacgggactccgaagcccagcggctccccgactccttcaaggacagccccagtaagggccttggaccttgcggatggattttggtggcgttctcattcttattcaccgttataactttcccaatctcaatatggatgtgcataaagattataaaagagtatgaaagagccatcatctttagattgggtcgcattttacaaggaggagccaaaggacctggtttgttttttattctgccatgcactgacagcttcatcaaagtggacatgagaactatttcatttgatattcctcctcaggagatcctcacaaaggattcagtgacaattagcgtggatggtgtggtctattaccgcgttcagaatgcaaccctggctgtggcaaatatcaccaacgctgactcagcaacccgtcttttggcacaaactactctgaggaatgttctgggcaccaagaatctttctcagatcctctctgacagagaagaaattgcacacaacatgcagtctactctggatgatgccactgatgcctggggaataaaggtggagcgtgtggaaattaaggatgtgaaactacctgtgcagctccagagagctatggctgcagaagcagaagcgtcccgcgaggcccgcgccaaggttattgcagccgaaggagaaatgaatgcatccagggctctgaaagaagcctccatggtcatcactgaatctcctgcagcccttcagctccgatacctgcagacactgaccaccattgctgctgagaaaaactcaacaattgtcttccctctgcccatagatatgctgcaaggaatcataggggcaaaacacagccatctaggctagtgtagagatgagcgctagccttccaagcatgaagtcggggaccaaattagcctttaactcataaagagagggtagggcttttctttttccatatgtcaattgtggtgttcccagaatgtatagcagttataaaaataggtgaaagaattgttagcttgtaaatactgagagattggtgatttatataaggtaatctgttagtcttaaaatagttaaaagtttgtatttttagattattatgtagtaggttagatccctcttgttttgacttccactgactcattctgaaccccctaagcacccaggccagaggcaagaacctgggctgtaactgccacctgacaccgctgactggctaaatgctttgcagaaagtgatgaccttacaccacaaccagcttctccaggtcatatgtgccttacctccagagagtctttttttttttttttctgagatggagtttcactcttgttgcccaggctggagtgcaatagcatgatctcggctcactgcaacctccgcctcctgggttcaagagattctcctgcctcagcctccccagtagctgggattacaggctcatgccaccatgcccagctaatttttgtattattattattgttttttagtagagacggggtttcaccatgttggccaggctagtcacgaactcctaacctcaggtgatccacccacctctgcctcccaaagtgctgggattacaggcatgagctaccacacctggtttggagagtcttaattaaggaaatttccctaatgttcatttattttctaaatccagaccgtgtttcagaataatccttacttgagagtagccattttcttgcctgtacttgtcagaactagaggaaatagccaagactaatgaaaaagattactctaacccttaaaagacttttaaattcactactagagtggtcattttaaaaatacatccatgttttaacttatttgagccttctttatgagtaaatgattcctccttgttctgtctttcaaaccagctaaatatttgtcacaaaagtgcttttttctcactgttgcctattttcatatatcaggttttaaatagttttaattttttaataaaattttctctacgttctatatgcaattgttatatatctatttgaatagctgaaggactaaaatacttttttaagagataacttcaggaaaccattatattttactatctgcatgctgttaactgtggtacactgtgaaatatgttgattacaaacccattcattacatagtataaggaattcacagtatattgactatatagtgtctaatgatcttgggcagatactgtcaaacttacaatatctatatagatgtaggtctttttaaatttacctagtcattcttctatcatgtatattgatgctgaaagaggaactggtcagctcctctggacaacaaattcttagtctataatattaggagacatcttctgttttgcaaatgtctgtgaatctgagcaacctggcattctgcttactggccagaaagctggcgggtgacatttgtaacatttcctctttgagactctgagttcacctagagaagtctaagcataacagctttctttcccagcacgagcctttatagctctctttagctcaaccactctgtccatccagccaatggatgtcccttcccctgtaccccaatttcaagcttattttaggaagccttgaactaccatgtatcctggctcctagctgagtttattagaggtatggagcagtgcaacttaaactcaagttgcacttacattttgaattttaaaatgatggttttatctgttgtgtgaagtggttcacccttgaggaccaggagcctccatatcctgactgaaaaccttttctgagacttagagtaacagtacttttggttccttgagttctcctgtctccagataccaaatgaccttgacttttctgccttgtgaattcgtagtccaatcagctgaaattaaatcacttgggagggacgcatagaaggagctctaggaacacagtgccagtgcagaagtttctccaggtggcctccctttccaacaatgtacataataaagtgtatgcactttcactaatatttttggggtgagagtctgtttcggcctgtattgaatgtctgtggatttccgttttcagaagtagta

SEQ ID NO: 1023 - DNA, 3090 bp, Homo sapiens
cgaggacgggggagtgcgactgcgtctcgggcagcatggccgagaagcggcacacacgggactccgaagcccagcggctccccgactcagacagccccagtaagggccttggaccttgcggatggattttggtggcgttctcattcttattcaccgttataactttcccaatctcaatatggatgtgcataaagattataaaagagtatgaaagagccatcatctttagattgggtcgcattttacaaggaggagccaaaggacctggtttgttttttattctgccatgcactgacagcttcatcaaagtggacatgagaactatttcatttgatattcctcctcaggagatcctcacaaaggattcagtgacaattagcgtggatggtgtggtctattaccgcgttcagaatgcaaccctggctgtggcaaatatcaccaacgctgactcagcaacccgtcttttggcacaaactactctgaggaatgttctgggcaccaagaatctttctcagatcctctctgacagagaagaaattgcacacaacatgcagtctactctggatgatgccactgatgcctggggaataaaggtggagcgtgtggaaattaaggatgtgaaactacctgtgcagctccagagagctatggctgcagaagcagaagcgtcccgcgaggcccgcgccaaggttattgcagccgaaggagaaatgaatgcatccagggctctgaaagaagcctccatggtcatcactgaatctcctgcagcccttcagctccgatacctgcagacactgaccaccattgctgctgagaaaaactcaacaattgtcttccctctgcccatagatatgctgcaaggaatcataggggcaaaacacagccatctaggctagtgtagagatgagcgctagccttccaagcatgaagtcggggaccaaattagcctttaactcataaagagagggtagggcttttctttttccatatgtcaattgtggtgttcccagaatgtatagcagttataaaaataggtgaaagaattgttagcttgtaaatactgagagattggtgatttatataaggtaatctgttagtcttaaaatagttaaaagtttgtatttttagattattatgtagtaggttagatccctcttgttttgacttccactgactcattctgaaccccctaagcacccaggccagaggcaagaacctgggctgtaactgccacctgacaccgctgactggctaaatgctttgcagaaagtgatgaccttacaccacaaccagcttctccaggtcatatgtgccttacctccagagagtctttttttttttttttctgagatggagtttcactcttgttgcccaggctggagtgcaatagcatgatctcggctcactgcaacctccgcctcctgggttcaagagattctcctgcctcagcctccccagtagctgggattacaggctcatgccaccatgcccagctaatttttgtattattattattgttttttagtagagacggggtttcaccatgttggccaggctagtcacgaactcctaacctcaggtgatccacccacctctgcctcccaaagtgctgggattacaggcatgagctaccacacctggtttggagagtcttaattaaggaaatttccctaatgttcatttattttctaaatccagaccgtgtttcagaataatccttacttgagagtagccattttcttgcctgtacttgtcagaactagaggaaatagccaagactaatgaaaaagattactctaacccttaaaagacttttaaattcactactagagtggtcattttaaaaatacatccatgttttaacttatttgagccttctttatgagtaaatgattcctccttgttctgtctttcaaaccagctaaatatttgtcacaaaagtgcttttttctcactgttgcctattttcatatatcaggttttaaatagttttaattttttaataaaattttctctacgttctatatgcaattgttatatatctatttgaatagctgaaggactaaaatacttttttaagagataacttcaggaaaccattatattttactatctgcatgctgttaactgtggtacactgtgaaatatgttgattacaaacccattcattacatagtataaggaattcacagtatattgactatatagtgtctaatgatcttgggcagatactgtcaaacttacaatatctatatagatgtaggtctttttaaatttacctagtcattcttctatcatgtatattgatgctgaaagaggaactggtcagctcctctggacaacaaattcttagtctataatattaggagacatcttctgttttgcaaatgtctgtgaatctgagcaacctggcattctgcttactggccagaaagctggcgggtgacatttgtaacatttcctctttgagactctgagttcacctagagaagtctaagcataacagctttctttcccagcacgagcctttatagctctctttagctcaaccactctgtccatccagccaatggatgtcccttcccctgtaccccaatttcaagcttattttaggaagccttgaactaccatgtatcctggctcctagctgagtttattagaggtatggagcagtgcaacttaaactcaagttgcacttacattttgaattttaaaatgatggttttatctgttgtgtgaagtggttcacccttgaggaccaggagcctccatatcctgactgaaaaccttttctgagacttagagtaacagtacttttggttccttgagttctcctgtctccagataccaaatgaccttgacttttctgccttgtgaattcgtagtccaatcagctgaaattaaatcacttgggagggacgcatagaaggagctctaggaacacagtgccagtgcagaagtttctccaggtggcctccctttccaacaatgtacataataaagtgtatgcactttcactaatatttttggggtgagagtctgtttcggcctgtattgaatgtctgtggatttccgttttcagaagtagta

SEQ ID NO: 1024 - DNA, 3002 bp, Homo sapiens
agacagccccagtaagggccttggaccttgcggatggattttggtggcgttctcattcttattcaccgttataactttcccaatctcaatatggatgtgcataaagattataaaagagtatgaaagagccatcatctttagattgggtcgcattttacaaggaggagccaaaggacctggtttgttttttattctgccatgcactgacagcttcatcaaagtggacatgagaactatttcatttgatattcctcctcaggagatcctcacaaaggattcagtgacaattagcgtggatggtgtggtctattaccgcgttcagaatgcaaccctggctgtggcaaatatcaccaacgctgactcagcaacccgtcttttggcacaaactactctgaggaatgttctgggcaccaagaatctttctcagatcctctctgacagagaagaaattgcacacaacatgcagtctactctggatgatgccactgatgcctggggaataaaggtggagcgtgtggaaattaaggatgtgaaactacctgtgcagctccagagagctatggctgcagaagcagaagcgtcccgcgaggcccgcgccaaggttattgcagccgaaggagaaatgaatgcatccagggctctgaaagaagcctccatggtcatcactgaatctcctgcagcccttcagctccgatacctgcagacactgaccaccattgctgctgagaaaaactcaacaattgtcttccctctgcccatagatatgctgcaaggaatcataggggcaaaacacagccatctaggctagtgtagagatgagcgctagccttccaagcatgaagtcggggaccaaattagcctttaactcataaagagagggtagggcttttctttttccatatgtcaattgtggtgttcccagaatgtatagcagttataaaaataggtgaaagaattgttagcttgtaaatactgagagattggtgatttatataaggtaatctgttagtcttaaaatagttaaaagtttgtatttttagattattatgtagtaggttagatccctcttgttttgacttccactgactcattctgaaccccctaagcacccaggccagaggcaagaacctgggctgtaactgccacctgacaccgctgactggctaaatgctttgcagaaagtgatgaccttacaccacaaccagcttctccaggtcatatgtgccttacctccagagagtctttttttttttttttctgagatggagtttcactcttgttgcccaggctggagtgcaatagcatgatctcggctcactgcaacctccgcctcctgggttcaagagattctcctgcctcagcctccccagtagctgggattacaggctcatgccaccatgcccagctaatttttgtattattattattgttttttagtagagacggggtttcaccatgttggccaggctagtcacgaactcctaacctcaggtgatccacccacctctgcctcccaaagtgctgggattacaggcatgagctaccacacctggtttggagagtcttaattaaggaaatttccctaatgttcatttattttctaaatccagaccgtgtttcagaataatccttacttgagagtagccattttcttgcctgtacttgtcagaactagaggaaatagccaagactaatgaaaaagattactctaacccttaaaagacttttaaattcactactagagtggtcattttaaaaatacatccatgttttaacttatttgagccttctttatgagtaaatgattcctccttgttctgtctttcaaaccagctaaatatttgtcacaaaagtgcttttttctcactgttgcctattttcatatatcaggttttaaatagttttaattttttaataaaattttctctacgttctatatgcaattgttatatatctatttgaatagctgaaggactaaaatacttttttaagagataacttcaggaaaccattatattttactatctgcatgctgttaactgtggtacactgtgaaatatgttgattacaaacccattcattacatagtataaggaattcacagtatattgactatatagtgtctaatgatcttgggcagatactgtcaaacttacaatatctatatagatgtaggtctttttaaatttacctagtcattcttctatcatgtatattgatgctgaaagaggaactggtcagctcctctggacaacaaattcttagtctataatattaggagacatcttctgttttgcaaatgtctgtgaatctgagcaacctggcattctgcttactggccagaaagctggcgggtgacatttgtaacatttcctctttgagactctgagttcacctagagaagtctaagcataacagctttctttcccagcacgagcctttatagctctctttagctcaaccactctgtccatccagccaatggatgtcccttcccctgtaccccaatttcaagcttattttaggaagccttgaactaccatgtatcctggctcctagctgagtttattagaggtatggagcagtgcaacttaaactcaagttgcacttacattttgaattttaaaatgatggttttatctgttgtgtgaagtggttcacccttgaggaccaggagcctccatatcctgactgaaaaccttttctgagacttagagtaacagtacttttggttccttgagttctcctgtctccagataccaaatgaccttgacttttctgccttgtgaattcgtagtccaatcagctgaaattaaatcacttgggagggacgcatagaaggagctctaggaacacagtgccagtgcagaagtttctccaggtggcctccctttccaacaatgtacataataaagtgtatgcactttcactaatatttttggggtgagagtctgtttcggcctgtattgaatgtctgtggatttccgttttcagaagtagta

SEQ ID NO: 1025 - DNA, 1913 bp, Homo sapiens
aattcggcacgaggcccgacctccgcagtcccagccgagccgcgacccttccggccgtccccaccccacctcgccgccatgcgcctccgccgcctagcgctgttcccgggtgtggcgctgcttcttgccgcggcccgcctcgccgctgcctccgacgtgctagaactcacggacgacaacttcgagagtcgcatctccgacacgggctctgcgggcctcatgctcgtcgagttcttcgctccctggtgtggacactgcaagagacttgcacctgagtatgaagctgcagctaccagattaaaaggaatagtcccattagcaaaggttgattgcactgccaacactaacacctgtaataaatatggagtcagtggatatccaaccctgaagatatttagagatggtgaagaagcaggtgcttatgatggacctaggactgctgatggaattgtcagccacttgaagaagcaggcaggaccagcttcagtgcctctcaggactgaggaagaatttaagaaattcattagtgataaagatgcctctatagtaggttttttcgatgattcattcagtgaggctcactccgagttcctaaaagcagccagcaacttgagggataactaccgatttgcacatacgaatgttgagtctctggtgaacgagtatgatgataatggagagggtatcatcttatttcgtccttcacatctcactaacaagtttgaggacaagactgtggcatatacagagcaaaaaatgaccagtggcaaaattaaaaagtttatccaggaaaacatttttggtatctgccctcacatgacagaagacaataaagatttgatacagggcaaggacttacttattgcttactatgatgtggactatgaaaagaacgctaaaggttccaactactggagaaacagggtaatgatggtggcaaagaaattcctggatgctgggcacaaactcaactttgctgtagctagccgcaaaacctttagccatgaactttctgattttggcttggagagcactgctggagagattcctgttgttgctatcagaactgctaaaggagagaagtttgtcatgcaggaggagttctcgcgtgatgggaaggctctggagaggttcctgcaggattactttgatggcaatctgaagagatacctgaagtctgaacctatcccagagagcaatgatgggcctgtgaaggtagtggtagcagagaattttgatgaaatagtgaataatgaaaataaagatgtgctgattgaattttatgccccttggtgtggtcattgtaagaacctggagcccaagtataaagaacttggcgagaagctcagcaaagacccaaatatcgtcatagccaagatggatgccacagccaatgatgtgccttctccatatgaagtcagaggttttcctaccatatacttctctccagccaacaagaagctaaatccaaagaaatatgaaggtggccgtgaattaagtgattttattagctatctacaaagagaagctacaaacccccctgtaattcaagaagaaaaacccaagaagaagaagaaggcacaggaggatctctaaagcagtagccaaacaccactttgtaaaaggactcttccatcagagatgggaaaaccattggggaggactaggacccatatgggaattattacctctcagggccgagaggacagaatggatataatctgaatcctgttaaattttctctaaactgtttcttagctgcactgtttatggaaataccaggaccagtttatgtttgtggttttgggaaaaattatttgtgttgggggaaatgttgtgggggtggggttgagttgggggtattttctaattttttttgtacatttggaacagtgacaataaatctcgtgccg

SEQ ID NO: 1026 - DNA, 2255 bp, Homo sapiens
atgacaacaaaagactgaagaactgacaacgattagaggacactaaggagacttaacaactaaatgcaaaatgggaccctgaatctgatcctggaacacaaaaactaaattagtagaaaagtggtaaaataggtggtcgcgcgcccgaccgccgcagtcccagtcgagccgcgacccttccggctgcccccaccccacctcgccgccatgtgcctccgccgcccagcgctgttcccgggcgtggcgctgcttctcgccgcggcccgcctcgcggctgcctccgacgtgctaggactcagggacgacaacttggagagtcgcatctccgacacgggctctgcgggcctcatgctcgtcgagttcttcgccccctggtgtggacactgcaagagacttgctcctgagtatgaagctgcagctaccagattaaaaggaatagtcccattagcaaaggctgattgcactgccaacactaacacctgtaataaatatggagtcagtggatatccaaccctgaatatgtttagagatggtgaagaagcaggtgcttatgatggacctaggactgctgatggaattgtcagccacctgaagaagcaggcaggcccagcttcagtgcctctcaggactgaggaagaatttaagaaattcattagtgataaagatgcctctatagtaggttttttcgatgattcattcagtgaagctcactccgagttcctaaaagcagccagcaacttgagggataactaccgatttgcacatacgaatgttgagtctctggtgaacgagtatgatgataacggagatggtatcatcttatttcgtccttcacatctcactaacaagttggaggacaagactgtggcatatacagtgcaaaaaatgaccagtggcaaaattaaaaagtttatccaggaaaacatttttggtatctgccctcacatgacagaagacaataaagatttgatacagggcaaggacttacttattgcttactatgatgtggactatgaaaagaatgctaaaggttccaactactggagaaacagggtaatgatggtggcaaagaaattcctggatgctgggcacaaactcaactttgctgtagctagccgcaaaacctttagccatgaactttctgattttggcttggagagcactgctggagagattcctgttgttgctatcagaactgctaaaggagagaagtttgtcatgcaggaggatttctcgcgtgatgggaatgctctggagaggttcctgcaggattactttgatggcaatctgaagagatacctgaagtctgaacctatcccagagagcaatgatgggcctgtgaaggtagtggtagcagagaattttgatgaaatagtgaataatgaaaataaagatgtgctgattgaattttatgccccttggtgtggtcactgtaagaacctggagcccaagtataaagaacttggcgagaagctcagcaaagacctgaatatcgtcatagccaagatggatgccacagccaatgatgtgccttctccatatgaagtcagagttttcctaccatatacttctctccagccaacaagaagctaaatccaaagaaatatgaaggtggccatgaattaagtgattttattagctatctacaacgagaagctacaaacccccctgtaattcaagaagaaaaacccaagaagaagaaggcacaggaggatctctaaagcagtaggcaaacaccactttgtaaaaggactcttccaccagagatgggaaaaccactggggaggactaggacccatatgggaattattacgtctcagggccgagaggacagaatggatataatctgaatcctgttaaattttctctaagccatttcttagctgcactgttatggaaataccaggaccagtttatgtttgtggttttgggaaaaattatttgtgttgggggaaatgttgtgggagtcgggttgagttgggggtattttctaatttttttgtgcatttggaacagtgacaataaataagacccctttaaactgtaaaaaaaaaaaaaataggaatgcggtccatggtttacttaatcgtataatatcagtgttcattttcttattttgataattgtcataatgttgtgtgaaatattctctttagggagcctgggaaagaatatataagaactctactgtttttgtaacttttgtggaggactgcaatcatttctaaataaatagtcttaaaaataactaaagt

SEQ ID NO: 1027 - DNA, 3070 bp, Homo sapiens
ccgggtttgggggttgggacctccggctgcaggtccgcctgggccagacgcgcgagcgcaagcagcgggttagtggtcgcgcgcccgacctccgcagtcccagccgagccgcgacccttccggccgtccccaccccacctcgccgccatgcgcctccgccgcctagcgctgttcccgggtgtggcgctgcttcttgccgcggcccgcctcgccgctgcctccgacgtgctagaactcacggacgacaacttcgagagtcgcatctccgacacgggctctgcgggcctcatgctcgtcgagttcttcgccccctggtgtggacactgcaagagacttgcacctgagtatgaagctgcagctaccagattaaaaggaatagtcccattagcaaaggttgattgcactgccaacactaacacctgtaataaatatggagtcagtggatatccaaccctgaagatatttagagatggtgaagaagcaggtgcttatgatggacctaggactgctgatggaattgtcagccacttgaagaagcaggcaggaccagcttcagtgcctctcaggactgaggaagaatttaagaaattcattagtgataaagatgcctctatagtaggttttttcgatgattcattcagtgaggctcactccgagttcctaaaagcagccagcaacttgagggataactaccgatttgcacatacgaatgttgagtctctggtgaacgagtatgatgataatggagagggtatcatcttatttcgtccttcacatctcactaacaagtttgaggacaagactgtggcatatacagagcaaaaaatgaccagtggcaaaattaaaaagtttatccaggaaaacatttttggtatctgccctcacatgacagaagacaataaagatttgatacagggcaaggacttacttattgcttactatgatgtggactatgaaaagaacgctaaaggttccaactactggagaaacagggtaatgatggtggcaaagaaattcctggatgctgggcacaaactcaactttgctgtagctagccgcaaaacctttagccatgaactttctgattttggcttggagagcactgctggagagattcctgttgttgctatcagaactgctaaaggagagaagtttgtcatgcaggaggagttctcgcgtgatgggaaggctctggagaggttcctgcaggattactttgatggcaatctgaagagatacctgaagtctgaacctatcccagagagcaatgatgggcctgtgaaggtagtggtagcagagaattttgatgaaatagtgaataatgaaaataaagatgtgctgattgaattttatgccccttggtgtggtcactgtaagaacctggagcccaagtataaagaacttggcgagaagctcagcaaagacccaaatatcgtcatagccaagatggatgccacagccaatgatgtgccttctccatatgaagtcagaggttttcctaccatatacttctctccagccaacaagaagctaaatccaaagaaatatgaaggtggccgtgaattaagtgattttattagctatctacaaagagaagctacaaacccccctgtaattcaagaagaaaaacccaagaagaagaagaaggcacaggaggatctctaaagcagtagccaaacaccactttgtaaaaggactcttccatcagagatgggaaaaccattggggaggactaggacccatatgggaattattacctctcagggccgagaggacagaatggatataatctgaatcctgttaaattttctctaaactgtttcttagctgcactgtttatggaaataccaggaccagtttatgtttgtggttttgggaaaaattatttgtgttgggggaaatgttgtgggggtggggttgagttgggggtattttctaattttttttgtacatttggaacagtgacaataaatgagacccctttaaactgtcttattttccaccagattgagaaccagatgttctctacacactatcactgttcaatagagctttcttcagtgatggaaatgctctgtaatctacactgttcagtacaggtagctacggagcatctgaaatatggctagaaactacatttttgttttgattaatttaaatagccatacagttgctaccatactggtcacggcagctgtagactgactgggtccatagttcatcacctcaaaattctttcaaaatttattatctctttctctccttacatgtttatttcccaggcctaccctggtgattagaacagctgaagggcctttcttgttaggctgtccatgccctaaggatgggttcctgtttatccttgccacgcagctgagcttactgcatgtttatatctcccaaggactgttctctgctcagaaatgccctgtcaagggtgtggcatcacgcagtttcatccaagttgtttcaggaattgctgacactgctgggtgcagttctatcccctaaagcctagggtgtggccctttaacttccccttcagtagaactgggaaaggcagtaccattcctagttatgagtgaagcatccactttcttttgtaacaatgaggaacagaaaggataagactgaagagtgatcttttgtccaactaaaccatttatctccttttgtaggtaaattcaaatcctgcccagttatagttttcagtcactggagaattccaggtaggagccctactttaggtgatcctaggaactcctatgttcagaaaagaattttcttcctactatataattacagtatttagctgtcaattttaagatgaatttggtagagccttatagtaaagtatgtatcttggtcacacacaaagcttggaaaaagtaaaagatgtctaaaccataatcttgtaactcataacatctgggctggggcccggggatctaattgtttagagagccccaaaagtggctcagatgtaaagccagggttaagaaccatctgccttggaagatttaagggaaacatataaacttgtacaaaggacacagaagcagtcagtttt

SEQ ID NO: 1028 - DNA, 153 bp, Homo sapiens
atggccagagcccgggccgctccccgacctccaaccgccagagcgatcacagccgccccccgcacgggggggcttaggggggccaagaacgggtggttcctgcgaaggggctatttcctggcccaagagctgggcagcggtcgtgaagattcg

SEQ ID NO: 1029 - DNA, 3312 bp, Homo sapiens
tgacaatatcaggtgagctgtggaggtggggtccttggaagctggatgacagcagctggcaaggggataagagagcagtgagcccctccctcaaggaggtctggctttatccatagacagggccctctgaggtggggctgaggtacaaagggggattgagcagcccaggagaagagagatgggggttcccttcttctcttctctcagatgcatggtggacttaggaccttgctgggctgggggtctcactgcagagatgaagctgcttctggccctagcagggctcctggccattctggccacgccccagccctctgaaggtgctgctccagctgtcctgggggaggtggacacctcgttggtgctgagctccatggaggaggccaagcagctggtggacaaggcctacaaggagcggcgggaaagcatcaagcagcggcttcgcagcggctcagccagccccatggaactcctatcctacttcaagcagccggtggcagccaccaggacggcggtgagggccgctgactacctgcacgtggctctagacctgctggagaggaagctgcggtccctgtggcgaaggccattcaatgtcactgatgtgctgacgcccgcccagctgaatgtgttgtccaagtcaagcggctgcgcctaccaggacgtgggggtgacttgcccggagcaggacaaataccgcaccatcaccgggatgtgcaacaacaggtgcggctggctgggggtggctgcaggaaccgggctcagagaggcgtcccggacgccacaagcctcccggtgtcagcgccctgtcctcccctgcagacgcagccccacgctgggggcctccaaccgtgcctttgtgcgctggctgccggcggagtatgaggacggcttctctcttccctacggctggacgcccggggtcaagcgcaacggcttcccggtggctctggctcgcgcggtctccaacgagatcgtgcgcttccccactgatcagctgactccggaccaggagcgctcactcatgttcatgcaatggggccagctgttggaccacgacctcgacttcacccctgagccggccgcccgggcctccttcgtcactggcgtcaactgcgagaccagctgcgttcagcagccgccctgcttcccgctcaagatcccgcccaatgacccccgcatcaagaaccaagccgactgcatcccgttcttccgctcctgcccggcttgccccgggagcaacatcaccatccgcaaccagatcaacgcgctcacttccttcgtggacgccagcatggtgtacggcagcgaggagcccctggccaggaacctgcgcaacatgtccaaccagctggggctgctggccgtcaaccagcgcttccaagacaacggccgggccctgctgccctttgacaacctgcacgatgacccctgtctcctcaccaaccgctcagcgcgcatcccctgcttcctggcaggggacacccgttccagtgagatgcccgagctcacctccatgcacaccctcttacttcgggagcacaaccggctggccacagagctcaagagcctgaaccctaggtgggatggggagaggctctaccaggaagcccggaagatcgtgggggccatggtccagatcatcacttaccgggactacctgcccctggtgctggggccaacggccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaacccaacccccgtgtccccctcagcagggtcttttttgcctcctggagggtcgtgctggaaggtggcattgaccccatcctccggggcctcatggccacccctgccaagctgaatcgtcagaaccaaattgcagtggatgagatccgggagcgattgtttgagcaggtcatgaggattgggctggacctgcctgctctgaacatgcagcgcagcagggaccacggcctcccaggatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcggtacccagttcaggaagctccgggatggtgatcggttttggtgggagaacgagggtgtgttcagcatgcagcagcgacaggccctggcccagatctcattgccccggatcatctgcgacaacacaggcatcaccaccgtgtctaagaacaacatcttcatgtccaactcatatccccgggactttgtcaactgcagtacacttcctgcattgaacctggcttcctggagggaagcctcctagaggccaggtaagggggtgcagcagtgaggggtatatctgggctggccagttggaaccacggagatctccttgccctagatgagcccagccctgttctgggtgcagctgagaaaatgagtgactagacgttcatttgtgtgctcatgtatgtgcgaagtatataaattggcttttcatgcgtgtgtgttgtctgaacatggggagtgtttcatgggttatgtgtatgtgccatttatgtgagtgtgtgtttgtgctgatgagaatactgagtatgtggaaggcagcagagcggactggtgaggagcacagctcaggaactagactgcctgggttccaatcctggctctgtggcttgctagctatgtgaccttgagcaaattaccctccttaaacaagagttttcttccttgtaaattacatctgtcatggtttcttggagggcccacttgtatcctctggttcttcatttattgagcacctactacatgcaaggcactgtactaggcgtgagaagcatatagaggcaagaaagagataccaagatgccatctgtgtcctggttagcagagctggaccagtggtgccttggagggataagccagctgcagctgggctgtgtggttgacttatgggcccagccagccaggctcaggccatggctcccctttttcttcctcaccctgatttcttgcttattcactgaagttctcctgaagaggaactgggcctgttgccctttctgtaccatttatttgctcccaatgtttatgataataaaggcaccgctgatggggacctcc

SEQ ID NO: 1030 - DNA, 3226 bp, Homo sapiens
tgacaatatcaggtgagctgtggaggtggggtccttggaagctggatgacagcagctggcaaggggataagagagcagtgagcccctccctcaaggaggtctggctttatccatagacagggccctctgaggtggggctgaggtacaaagggggattgagcagcccaggagaagagagatgggggttcccttcttctcttctctcagatgcatggtggacttaggaccttgctgggctgggggtctcactgcagagatgaagctgcttctggccctagcagggctcctggccattctggccacgccccagccctctgaaggtgctgctccagctgtcctgggggaggtggacacctcgttggtgctgagctccatggaggaggccaagcagctggtggacaaggcctacaaggagcggcgggaaagcatcaagcagcggcttcgcagcggctcagccagccccatggaactcctatcctacttcaagcagccggtggcagccaccaggacggcggtgagggccgctgactacctgcacgtggctctagacctgctggagaggaagctgcggtccctgtggcgaaggccattcaatgtcactgatgtgctgacgcccgcccagctgaatgtgttgtccaagtcaagcggctgcgcctaccaggacgtgggggtgacttgcccggagcaggacaaataccgcaccatcaccgggatgtgcaacaacagacgcagccccacgctgggggcctccaaccgtgcctttgtgcgctggctgccggcggagtatgaggacggcttctctcttccctacggctggacgcccggggtcaagcgcaacggcttcccggtggctctggctcgcgcggtctccaacgagatcgtgcgcttccccactgatcagctgactccggaccaggagcgctcactcatgttcatgcaatggggccagctgttggaccacgacctcgacttcacccctgagccggccgcccgggcctccttcgtcactggcgtcaactgcgagaccagctgcgttcagcagccgccctgcttcccgctcaagatcccgcccaatgacccccgcatcaagaaccaagccgactgcatcccgttcttccgctcctgcccggcttgccccgggagcaacatcaccatccgcaaccagatcaacgcgctcacttccttcgtggacgccagcatggtgtacggcagcgaggagcccctggccaggaacctgcgcaacatgtccaaccagctggggctgctggccgtcaaccagcgcttccaagacaacggccgggccctgctgccctttgacaacctgcacgatgacccctgtctcctcaccaaccgctcagcgcgcatcccctgcttcctggcaggggacacccgttccagtgagatgcccgagctcacctccatgcacaccctcttacttcgggagcacaaccggctggccacagagctcaagagcctgaaccctaggtgggatggggagaggctctaccaggaagcccggaagatcgtgggggccatggtccagatcatcacttaccgggactacctgcccctggtgctggggccaacggccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaacccaacccccgtgtccccctcagcagggtcttttttgcctcctggagggtcgtgctggaaggtggcattgaccccatcctccggggcctcatggccacccctgccaagctgaatcgtcagaaccaaattgcagtggatgagatccgggagcgattgtttgagcaggtcatgaggattgggctggacctgcctgctctgaacatgcagcgcagcagggaccacggcctcccaggatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcggtacccagttcaggaagctccgggatggtgatcggtgaggaggggttttggtgggagaacgagggtgtgttcagcatgcagcagcgacaggccctggcccagatctcattgccccggatcatctgcgacaacacaggcatcaccaccgtgtctaagaacaacatcttcatgtccaactcatatccccgggactttgtcaactgcagtacacttcctgcattgaacctggcttcctggagggaagcctcctagaggccaggtaagggggtgcagcagtgaggggtatatctgggctggccagttggaaccacggagatctccttgccctagatgagcccagccctgttctgggtgcagctgagaaaatgagtgactagacgttcatttgtgtgctcatgtatgtgcgaagtatataaattggcttttcatgcgtgtgtgttgtctgaacatggggagtgtttcatgggttatgtgtatgtgccatttatgtgagtgtgtgtttgtgctgatgagaatactgagtatgtggaaggcagcagagcggactggtgaggagcacagctcaggaactagactgcctgggttccaatcctggctctgtggcttgctagctatgtgaccttgagcaaattaccctccttaaacaagagttttcttccttgtaaattacatctgtcatggtttcttggagggcccacttgtatcctctggttcttcatttattgagcacctactacatgcaaggcactgtactaggcgtgagaagcatatagaggcaagaaagagataccaagatgccatctgtgtcctggttagcagagctggaccagtggtgccttggagggataagccagctgcagctgggctgtgtggttgacttatgggcccagccagccaggctcaggccatggctcccctttttcttcctcaccctgatttcttgcttattcactgaagttctcctgaagaggaactgggcctgttgccctttctgtaccatttatttgctcccaatgtttatgataataaaggcaccgctgatggggacctcc

SEQ ID NO: 1031 - DNA, 3357 bp, Homo sapiens
tgacaatatcaggtgagctgtggaggtggggtccttggaagctggatgacagcagctggcaaggggataagagagcagtgagcccctccctcaaggaggtctggctttatccatagacagggccctctgaggtggggctgaggtacaaagggggattgagcagcccaggagaagagagatgggggttcccttcttctcttctctcagatgcatggtggacttaggaccttgctgggctgggggtctcactgcagagatgaagctgcttctggccctagcagggctcctggccattctggccacgccccagccctctgaaggtgctgctccagctgtcctgggggaggtggacacctcgttggtgctgagctccatggaggaggccaagcagctggtggacaaggcctacaaggagcggcgggaaaggtggggcacgaggcactgcccagctctgggcaaggatgtcccaggcctttcagagaagcagcaggcagcagggagcttgaaggtgggagagggggactatggggacccatgtggactccctttctgtctgtctgtccctgtcatcaagcagcggcttcgcagcggctcagccagccccatggaactcctatcctacttcaagcagccggtggcagccaccaggacggcggtgagggccgctgactacctgcacgtggctctagacctgctggagaggaagctgcggtccctgtggcgaaggccattcaatgtcactgatgtgctgacgcccgcccagctgaatgtgttgtccaagtcaagcggctgcgcctaccaggacgtgggggtgacttgcccggagcaggacaaataccgcaccatcaccgggatgtgcaacaacagacgcagccccacgctgggggcctccaaccgtgcctttgtgcgctggctgccggcggagtatgaggacggcttctctcttccctacggctggacgcccggggtcaagcgcaacggcttcccggtggctctggctcgcgcggtctccaacgagatcgtgcgcttccccactgatcagctgactccggaccaggagcgctcactcatgttcatgcaatggggccagctgttggaccacgacctcgacttcacccctgagccggccgcccgggcctccttcgtcactggcgtcaactgcgagaccagctgcgttcagcagccgccctgcttcccgctcaagatcccgcccaatgacccccgcatcaagaaccaagccgactgcatcccgttcttccgctcctgcccggcttgccccgggagcaacatcaccatccgcaaccagatcaacgcgctcacttccttcgtggacgccagcatggtgtacggcagcgaggagcccctggccaggaacctgcgcaacatgtccaaccagctggggctgctggccgtcaaccagcgcttccaagacaacggccgggccctgctgccctttgacaacctgcacgatgacccctgtctcctcaccaaccgctcagcgcgcatcccctgcttcctggcaggggacacccgttccagtgagatgcccgagctcacctccatgcacaccctcttacttcgggagcacaaccggctggccacagagctcaagagcctgaaccctaggtgggatggggagaggctctaccaggaagcccggaagatcgtgggggccatggtccagatcatcacttaccgggactacctgcccctggtgctggggccaacggccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaacccaacccccgtgtccccctcagcagggtcttttttgcctcctggagggtcgtgctggaaggtggcattgaccccatcctccggggcctcatggccacccctgccaagctgaatcgtcagaaccaaattgcagtggatgagatccgggagcgattgtttgagcaggtcatgaggattgggctggacctgcctgctctgaacatgcagcgcagcagggaccacggcctcccaggatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcggtacccagttcaggaagctccgggatggtgatcggttttggtgggagaacgagggtgtgttcagcatgcagcagcgacaggccctggcccagatctcattgccccggatcatctgcgacaacacaggcatcaccaccgtgtctaagaacaacatcttcatgtccaactcatatccccgggactttgtcaactgcagtacacttcctgcattgaacctggcttcctggagggaagcctcctagaggccaggtaagggggtgcagcagtgaggggtatatctgggctggccagttggaaccacggagatctccttgccctagatgagcccagccctgttctgggtgcagctgagaaaatgagtgactagacgttcatttgtgtgctcatgtatgtgcgaagtatataaattggcttttcatgcgtgtgtgttgtctgaacatggggagtgtttcatgggttatgtgtatgtgccatttatgtgagtgtgtgtttgtgctgatgagaatactgagtatgtggaaggcagcagagcggactggtgaggagcacagctcaggaactagactgcctgggttccaatcctggctctgtggcttgctagctatgtgaccttgagcaaattaccctccttaaacaagagttttcttccttgtaaattacatctgtcatggtttcttggagggcccacttgtatcctctggttcttcatttattgagcacctactacatgcaaggcactgtactaggcgtgagaagcatatagaggcaagaaagagataccaagatgccatctgtgtcctggttagcagagctggaccagtggtgccttggagggataagccagctgcagctgggctgtgtggttgacttatgggcccagccagccaggctcaggccatggctcccctttttcttcctcaccctgatttcttgcttattcactgaagttctcctgaagaggaactgggcctgttgccctttctgtaccatttatttgctcccaatgtttatgataataaaggcaccgctgatggggacctcc

SEQ ID NO: 1032 - DNA, 3216 bp, Homo sapiens
tgacaatatcaggtgagctgtggaggtggggtccttggaagctggatgacagcagctggcaaggggataagagagcagtgagcccctccctcaaggaggtctggctttatccatagacagggccctctgaggtggggctgaggtacaaagggggattgagcagcccaggagaagagagatgggggttcccttcttctcttctctcagatgcatggtggacttaggaccttgctgggctgggggtctcactgcagagatgaagctgcttctggccctagcagggctcctggccattctggccacgccccagccctctgaaggtgctgctccagctgtcctgggggaggtggacacctcgttggtgctgagctccatggaggaggccaagcagctggtggacaaggcctacaaggagcggcgggaaagcatcaagcagcggcttcgcagcggctcagccagccccatggaactcctatcctacttcaagcagccggtggcagccaccaggacggcggtgagggccgctgactacctgcacgtggctctagacctgctggagaggaagctgcggtccctgtggcgaaggccattcaatgtcactgatgtgctgacgcccgcccagctgaatgtgttgtccaagtcaagcggctgcgcctaccaggacgtgggggtgacttgcccggagcaggacaaataccgcaccatcaccgggatgtgcaacaacagacgcagccccacgctgggggcctccaaccgtgcctttgtgcgctggctgccggcggagtatgaggacggcttctctcttccctacggctggacgcccggggtcaagcgcaacggcttcccggtggctctggctcgcgcggtctccaacgagatcgtgcgcttccccactgatcagctgactccggaccaggagcgctcactcatgttcatgcaatggggccagctgttggaccacgacctcgacttcacccctgagccggccgcccgggcctccttcgtcactggcgtcaactgcgagaccagctgcgttcagcagccgccctgcttcccgctcaagatcccgcccaatgacccccgcatcaagaaccaagccgactgcatcccgttcttccgctcctgcccggcttgccccgggagcaacatcaccatccgcaaccagatcaacgcgctcacttccttcgtggacgccagcatggtgtacggcagcgaggagcccctggccaggaacctgcgcaacatgtccaaccagctggggctgctggccgtcaaccagcgcttccaagacaacggccgggccctgctgccctttgacaacctgcacgatgacccctgtctcctcaccaaccgctcagcgcgcatcccctgcttcctggcaggggacacccgttccagtgagatgcccgagctcacctccatgcacaccctcttacttcgggagcacaaccggctggccacagagctcaagagcctgaaccctaggtgggatggggagaggctctaccaggaagcccggaagatcgtgggggccatggtccagatcatcacttaccgggactacctgcccctggtgctggggccaacggccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaacccaacccccgtgtccccctcagcagggtcttttttgcctcctggagggtcgtgctggaaggtggcattgaccccatcctccggggcctcatggccacccctgccaagctgaatcgtcagaaccaaattgcagtggatgagatccgggagcgattgtttgagcaggtcatgaggattgggctggacctgcctgctctgaacatgcagcgcagcagggaccacggcctcccaggatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcggtacccagttcaggaagctccgggatggtgatcggttttggtgggagaacgagggtgtgttcagcatgcagcagcgacaggccctggcccagatctcattgccccggatcatctgcgacaacacaggcatcaccaccgtgtctaagaacaacatcttcatgtccaactcatatccccgggactttgtcaactgcagtacacttcctgcattgaacctggcttcctggagggaagcctcctagaggccaggtaagggggtgcagcagtgaggggtatatctgggctggccagttggaaccacggagatctccttgccctagatgagcccagccctgttctgggtgcagctgagaaaatgagtgactagacgttcatttgtgtgctcatgtatgtgcgaagtatataaattggcttttcatgcgtgtgtgttgtctgaacatggggagtgtttcatgggttatgtgtatgtgccatttatgtgagtgtgtgtttgtgctgatgagaatactgagtatgtggaaggcagcagagcggactggtgaggagcacagctcaggaactagactgcctgggttccaatcctggctctgtggcttgctagctatgtgaccttgagcaaattaccctccttaaacaagagttttcttccttgtaaattacatctgtcatggtttcttggagggcccacttgtatcctctggttcttcatttattgagcacctactacatgcaaggcactgtactaggcgtgagaagcatatagaggcaagaaagagataccaagatgccatctgtgtcctggttagcagagctggaccagtggtgccttggagggataagccagctgcagctgggctgtgtggttgacttatgggcccagccagccaggctcaggccatggctcccctttttcttcctcaccctgatttcttgcttattcactgaagttctcctgaagaggaactgggcctgttgccctttctgtaccatttatttgctcccaatgtttatgataataaaggcaccgctgatggggacctcc

SEQ ID NO: 1033 - DNA, 2238 bp, Homo sapiens
atgggggttcccttcttctcttctctcagatgcatggtggacttaggaccttgctgggctgggggtctcactgcagagatgaagctgcttctggccctagcagggctcctggccattctggccacgccccagccctctgaaggtgctgctccagctgtcctgggggaggtggacacctcgttggtgctgagctccatggaggaggccaagcagctggtggacaaggcctacaaggagcggcgggaaagcatcaagcagcggcttcgcagcggctcagccagccccatggaactcctatcctacttcaagcagccggtggcagccaccaggacggcggtgagggccgctgactacctgcacgtggctctagacctgctggagaggaagctgcggtccctgtggcgaaggccattcaatgtcactgatgtgctgacgcccgcccagctgaatgtgttgtccaagtcaagcggctgcgcctaccaggacgtgggggtgacttgcccggagcaggacaaataccgcaccatcaccgggatgtgcaacaacagacgcagccccacgctgggggcctccaaccgtgcctttgtgcgctggctgccggcggagtatgaggacggcttctctcttccctacggctggacgcccggggtcaagcgcaacggcttcccggtggctctggctcgcgcggtctccaacgagatcgtgcgcttccccactgatcagctgactccggaccaggagcgctcactcatgttcatgcaatggggccagctgttggaccacgacctcgacttcacccctgagccggccgcccgggcctccttcgtcactggcgtcaactgcgagaccagctgcgttcagcagccgccctgcttcccgctcaagatcccgcccaatgacccccgcatcaagaaccaagccgactgcatcccgttcttccgctcctgcccggcttgccccgggagcaacatcaccatccgcaaccagatcaacgcgctcacttccttcgtggacgccagcatggtgtacggcagcgaggagcccctggccaggaacctgcgcaacatgtccaaccagctggggctgctggccgtcaaccagcgcttccaagacaacggccgggccctgctgccctttgacaacctgcacgatgacccctgtctcctcaccaaccgctcagcgcgcatcccctgcttcctggcaggggacacccgttccagtgagatgcccgagctcacctccatgcacaccctcttacttcgggagcacaaccggctggccacagagctcaagagcctgaaccctaggtgggatggggagaggctctaccaggaagcccggaagatcgtgggggccatggtccagatcatcacttaccgggactacctgcccctggtgctggggccaacggccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaacccaacccccgtgtccccctcagcagggtcttttttgcctcctggagggtcgtgctggaaggtggcattgaccccatcctccggggcctcatggccacccctgccaagctgaatcgtcagaaccaaattgcagtggatgagatccgggagcgattgtttgagcaggtcatgaggattgggctggacctgcctgctctgaacatgcagcgcagcagggaccacggcctcccaggatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcggtacccagttcaggaagctccgggatggtgatcggttttggtgggagaacgagggtgtgttcagcatgcagcagcgacaggccctggcccagatctcattgccccggatcatctgcgacaacacaggcatcaccaccgtgtctaagaacaacatcttcatgtccaactcatatccccgggactttgtcaactgcagtacacttcctgcattgaacctggcttcctggagggaagcctcctag

SEQ ID NO: 1034 - DNA, 2081 bp, Homo sapiens
aattcctcggctcctggcgggagtgccggtggcgccccgcagtccgcttgtccgtccttccctctctgactctcctaccccgggcctgtctctgcagaggtcaggggaggcgggggcccagcacacgtccccagtggcagcgggagcggcagctacgggttcgcggagcccccgaccccccaagggctagaggagcgctcggcggaccaaagaaagcccgcgagcggctgcgcgcccaccaataggtgcggggctcggagccgcgcagcctgcgccgtccctccctccgcccccgccccgccgccgccgccgccgccgcctccccctcctcctgctcctgccttggctcctccgccgcgcgtctcgcactccgagagccgcagcggcagcggcgcgtcctgcctgcagagagccaggccggagaagccgagcggcgcagaggacgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaaggcaacctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccgtaactgacttgtagtaagcagtgtttctggcccctaagtattgctgccttgtgtattttatttagtgtacagtactacaggtgcatactctggtcatttttcaagccatgttttattgtatctgttttctactttatgtgagcaaggtttgctgtccaaggtgtaaatattcaacgggaataaaactggcatggtaatttttttttttttttttttttttgttttttggaactgccctttaaattttaagtgacactacagaaaaacacaaaaaggtgatgggttgtgttatgcttgtattgaatgctgtcttgacatctcttgccttgtcctccggtatgttctaaagctgtgtctgagatctggatctgcccatcactttggctagtga

SEQ ID NO: 1035 - DNA, 2587 bp, Homo sapiens
aattcctcggctcctggcgggagtgccggtggcgccccgcagtccgcttgtccgtccttccctctctgactctcctaccccgggcctgtctctgcagaggtcaggggaggcgggggcccagcacacgtccccagtggcagcgggagcggcagctacgggttcgcggagcccccgaccccccaagggctagaggagcgctcggcggaccaaagaaagcccgcgagcggctgcgcgcccaccaataggtgcggggctcggagccgcgcagcctgcgccgtccctccctccgcccccgccccgccgccgccgccgccgccgcctccccctcctcctgctcctgccttggctcctccgccgcgcgtctcgcactccgagagccgcagcggcagcggcgcgtcctgcctgcagagagccaggccggagaagccgagcggcgcagaggacgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaagcctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccgtaactgacttgtagtaagcagtgtttctggcccctaagtattgctgccttgtgtattttatttagtgtacagtactacaggtgcatactctggtcatttttcaagccatgttttattgtatctgttttctactttatgtgagcaaggtttgctgtccaaggtgtaaatattcaacgggaataaaactggcatggtaatttttttttttttttttttttttgttttttggctctttcaaaggtaatggcccatcgatgagcatttttaacatactccatagtcttttcctgtggtgttaggtctttatttttatttttttcctgggggctggggtgggggtttgtcatgggggaactgccctttaaattttaagtgacactacagaaaaacacaaaaaggtgatgggttgtgttatgcttgtattgaatgctgtcttgacatctcttgccttgtcctccggtatgttctaaagctgtgtctgagatctggatctgcccatcactttggctagtgacagggctaattaatttgctttatacattttcttttactttccttttttcctttctggaggcatcacatgctggtgctgtgtctttatgaatgttttaaccattttcatggtggaagaattttatatttatgcagttgtacaattttatttttttctgcaagaaaaagtgtaatgtatgaaataaaccaaagtcacttgtttgaaaataaatctttattttgaactttataaaaagcaatgcagtaccccatagactggtgttaaatgttgtctacagtgcaaaatccatgttctaacatatgtaataattgccaggagtacagtgctcttgttgatcttgtattcagtcaggttaaaacaacggacaataaaagaatgaacacattc

SEQ ID NO: 1036 - DNA, 1221 bp, Homo sapiens
agaagccgagcggcgcagaggacgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaagcctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaaaaaaaaaaaaaaa

SEQ ID NO: 1037 - DNA, 2635 bp, Homo sapiens
cgcgcgcaccacaacgcccccgccccgccgcccggaaccagctgagcgcagctggacccagcagccgctgtctccagtgccgcagcagcaggtagtgctcatagctctctttgtccagtgcttcggccttggtcccagcgccttcccacggagcagcactcttcaccctgcacagccttgttagcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggcaagcaggcaaacacggaggagaggaaggctgccctcaaaacagcctctgacttcatcaccaagatggactaccccaagcagactcaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgccacatatggacagttctatggaggcgacagctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttttacagtatccaaaaatagccctgcaaaaattcagagtccttgcaaaattgtctaaaatgtcagtgtttgggaaattaaatccaataaaaacattttgaagtgtgtactcta

SEQ ID NO: 1038 - DNA, 2658 bp, Homo sapiens
cgcgcgcaccacaacgcccccgccccgccgcccggaaccagctgagcgcagctggacccagcagccgctgtctccagtgccgcagcagcaggtagtgctcatagctctctttgtccagtgcttcggccttggtcccagcgccttcccacggagcagcactcttcaccctgcacagccttgttagcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggcaagcaggcaaacacggaggagaggaaggctgccctcaaaacagcctctgacttcatcaccaagatggactaccccaagcagactcaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgccacatatggacagttctatggaggcgacagctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttttacagtatccaaaaatagccctgcaaaaattcagagtccttgcaaaattgtctaaaatgtcagtgtttgggaaattaaatccaataaaaacattttgaagtgtgaaaaaaaaaaaaaaaaaaaaaaaaaaaaaa

SEQ ID NO: 1039 - DNA, 2706 bp, Homo sapiens
cgcgcgcaccacaacgcccccgccccgccgcccggaaccagctgagcgcagctggacccagcagccgctgtctccagtgccgcagcagcaggtagtgctcatagctctctttgtccagtgcttcggccttggtcccagcgccttcccacggagcagcactcttcaccctgcacagccttgttagttcttgcagatacagcgctaggaaaaggggagtaattcaggtctagaatggaaaaactgttttgttgctttcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggcaagcaggcaaacacggaggagaggaaggctgccctcaaaacagcctctgacttcatcaccaagatggactaccccaagcagactcaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgccacatatggacagttctatggaggcgacagctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttttacagtatccaaaaatagccctgcaaaaattcagagtccttgcaaaattgtctaaaatgtcagtgtttgggaaattaaatccaataaaaacattttgaagtgtgtactcta

SEQ ID NO: 1040 - DNA, 2670 bp, Homo sapiens
atgggcgggcggctacttaaggtcggcgacccgaggccgcggctgccgactgggtcccctgccgctgtcgccaccatggctccgcaccgccccgcgcccgcgctgctttgcgcgctgtccctggcgctgtgcgcgctgtcgctgcccgtccgcgcggccactgcgtcgcggggggcgtcccaggcgggggcgccccaggggcgggtgcccgaggcgcggcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggcaagcaggcaaacacggaggagaggaaggctgccctcaaaacagcctctgacttcatcaccaagatggactaccccaagcagactcaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgccacatatggacagttctatggaggcgacagctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttttacagtatccaaaaatagccctgcaaaaattcagagtccttgcaaaattgtctaaaatgtcagtgtttgggaaattaaatccaataaaaacattttgaagtgtgtactcta

SEQ ID NO: 1041 - DNA, 2663 bp, Homo sapiens
ccaccatggctccgcaccgccccgcgcccgcgctgctttgcgcgctgtccctggcgctgtgcgcgctgtcgctgcccgtccgcgcggccactgcgtcgcggggggcgtcccaggcgggggcgccccaggggcgggtgcccgaggcgcggcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggcaagcaggcaaacacggaggagaggaaggctgccctcaaaacagcctctgacttcatcaccaagatggactaccccaagcagactcaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgccacatatggacagttctatggaggcgacagctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttttacagtatccaaaaatagccctgcaaaaattcagagtccttgcaaaattgtctaaaatgtcagtgtttgggaaattaaatccaataaaaacattttgaagtgtgaaaaaaaaaaaaaaaaaaaaaaaaaaaaaaaaaaaaaaaaaaaaaaaaaaaaaaaaaaaaaaaaaaaaaa

SEQ ID NO: 1042 - DNA, 3701 bp, Homo sapiens
cccagtctcccggccacggttgaaaccagacgtgcagtggggctgacccctgtgccccaccccagagtcatgccagcgtgggtggtggggcattctctgggatgaatgatctggatcccatagccatctgtgtcctgtttgaggaatgggaccctcaaacagagaacagccaagatgctcaagcagtggtttatctctagggtctccatagcaggggaggtagggtcagactcctgagatggctgatgtcctaccctgcccccaaccaggggccccaggagactcctttttcttactgcaactttggcctcctcagtctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatgctaaagatgtgattaaagagattgaagactttgacagcttggaggctctgcgtctggaaggcaacacagtgggcgtggaagcagccagggtcatcgccaaggccttagagaagaagtcggagttgaagcgctgccactggagtgacatgttcacgggaaggctgcggaccgagatcccaccagccctgatctcactaggggaaggactcatcacagctggggctcagctggtggagctggacttaagcgacaacgcattcgggcccgacggtgtgcaaggcttcgaggccctgctcaagagctcagcctgcttcaccctgcaggaactcaagctcaacaactgtggcatgggcattggcggcggcaagatcctggctgcagctctgaccgaatgtcaccggaaatccagtgcccaaggcaagcctctggccctgaaggtctttgtggctggcagaaaccgtctggagaatgatggcgccactgccttggcagaagcttttagggtcatcgggaccctggaggaggtccacatgccacagaatgggatcaaccaccctggcatcactgccctggcccaggctttcgctgtcaaccccctgctgcgggtcatcaacctgaatgacaacaccttcactgagaagggcgccgtggccatggccgagaccttgaagaccttgcggcaggtggaggtgattaattttggggactgcctggtgcgctccaagggtgcagttgccattgcagatgccatccgcggcggcctgcccaagctaaaggagctgaacttgtcattctgtgaaatcaagagggatgctgccctggctgttgctgaggccatggcagacaaagctgagctggagaagctggacctgaatggtagcaacaccctgggagaagaaggctgtgaacagcttcaggaggtgctggagggcttcaacatggccaaggtgctggcgtccctcagtgatgacgaggacgaggaggaggaggaggaaggagaagaggaagaagaggaagcagaagaagaggaggaggaagatgaggaagaggaggaagaagaggaggaggaggaggaagaagagcctcagcagcgagggcagggagagaagtcagccacgccctcacggaagattctggaccctaacactggggagccagctcccgtgctgtcctccccacctcctgcagacgtctccaccttcctggcttttccctctccagagaagctgctgcgcctagggcccaagagctccgtgctgatagcccagcagactgacacgtctgaccccgagaaggtggtctctgccttcctaaaggtgtcatctgtgttcaaggacgaagctactgtgaggatggcagtgcaggatgcagtagatgccctgatgcagaaggctttcaactcctcgtccttcaactccaacaccttcctcaccaggctcctcgtgcacatgggtctgctcaagagtgaagacaaggtcaaggccattgccaacctgtacggccccctgatggcgctgaaccacatggtgcagcaggactatttccccaaggcccttgcacccctgctgctggcgttcgtgaccaagcccaacagcgccctggaatcctgctccttcgcccgccacagtctgctgcagacgctgtacaaggtctagactcaaagcctctcccatcccttggcctggaccagtgagctggggagggactcggatgaactgaggcgcagcctacgccattgccttggacaggactctggccacaggcagggcgggtctgtgtcccatgtgtcctgtcagtcccctgagtatgtgtgtgggtgtggcgcatgtgcaggtctgtgcctcctgtcgggatttgggttttaacgtcttctgctggcccagccctgctctgttgtggggagttggcccccaggggaaagggctgtgagctgctccgccattaaactcacctccacctgagggcgctctgctgatctccgcctgggccctgatggccgtccccacccacctgccttccggcccggctccctggcggagccagaacccagggagttgcccgcgtgctgtccttcccctctgtgttgtgattgggttgtttcctgccctgcctggggctgcttctcgtcaccaagccctggtcctgcggcagctgtcacccctaccatccataccactgtgctgaccgctcagcctgaagagcagagaatgccatgggtgggactgtgggggtcggatcgtggggttgttggcagagggcaaccctgggccccacaccgtgtggacaggcagacaccagattgtccaggagcaggagctgctgggactgcgctggccccggacctagtgggccttctcctggctgctgagatgtcgtctgtgactggcctggctggagggggagtgttgacaacccaaagctgttctccagtctggggagggagaggcagggtccccaatgtccgagctgcatctggacgctgctcttaaaggacctcctggggcaggggagcggtagggtctggactgggcagatgctgtatgacctccctgagcacccgtgactgccccatgctttcccctttgtgctctgtgtgtgtctgggctgtgcccgggggcttcacaaataaagtcgtgtggcagcttcagagactcagaaactctcactgaaagcgggatagtctcgggggccgttgtacgtggagtcccacctcggcagagcatgcggccccgcagcagtctgtggggcagtcagccctgcagaagggcccggcctcggcctcaggccactacctgggaagtggcagtcctgagtgggggcccattttcctgcctggccacacctcacccagcaccctgcctttgggctgcagctcgcttggcttctgcgttgctccttcactatggaagccacctcccttgggatcctttgctccactgccacatatgtgaggacagcccagccaaccttccttacctcctaccctacaccatgtatgtgctttgggagcccatgtcccccacaaacggcctccaagaagtccctccaaggtttcttagagggcaatattttctcattggcagtcggccacgtaggtgaccaggtggcagaggatactgctggccctgtcccctgtcttctgtgtgagttgatacggtagggggtgggtgtggggctggcattaagttctgatgccagctacaacgtggatgaactttgaaaacatgttaaatga

SEQ ID NO: 1043 - DNA, 3057 bp, Homo sapiens
gccgcctgtttacggtagagtcagggtccctttcctttccccgtcacctgcctggaacaggggtgcggggcgaggagggcgtggcgcccgtgtgcgccttctgcctgccccctcggccttcttcacttagccttcgacggccgagcgccccaggggtggcggtgggagtggggttgttgagcggcgctggctcctttcacaaatggggaaactgaggcttaaagggcgtctgactcgccagagcagctcagcctgcagctgctagcagtggcgtctcatattagcattgttgtcaaccggaggcggtgcgagtccgccggggattccagatggggctcctgcgccgcccgcctatcatttgcggcctgtattcgcgcgtcgctcccgcagagccacctcccagcaggcccacgcccgcgggggccccgggctggcgccgctgtccctggaatcgattctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatgctaaagatgtgattaaagagattgaagactttgacagcttggaggctctgcgtctggaaggcaacacagtgggcgtggaagcagccagggtcatcgccaaggccttagagaagaagtcggagttgaagcgctgccactggagtgacatgttcacgggaaggctgcggaccgagatcccaccagccctgatctcactaggggaaggactcatcacagctggggctcagctggtggagctggacttaagcgacaacgcattcgggcccgacggtgtgcaaggcttcgaggccctgctcaagagctcagcctgcttcaccctgcaggaactcaagctcaacaactgtggcatgggcattggcggcggcaagatcctggctgcagctctgaccgaatgtcaccggaaatccagtgcccaaggcaagcctctggccctgaaggtctttgtggctggcagaaaccgtctggagaatgatggcgccactgccttggcagaagcttttagggtcatcgggaccctggaggaggtccacatgccacagaatgggatcaaccaccctggcatcactgccctggcccaggctttcgctgtcaaccccctgctgcgggtcatcaacctgaatgacaacaccttcactgagaagggcgccgtggccatggccgagaccttgaagaccttgcggcaggtggaggtgattaattttggggactgcctggtgcgctccaagggtgcagttgccattgcagatgccatccgcggcggcctgcccaagctaaaggagctgaacttgtcattctgtgaaatcaagagggatgctgccctggctgttgctgaggccatggcagacaaagctgagctggagaagctggacctgaatggcaacaccctgggagaagaaggctgtgaacagcttcaggaggtgctggagggcttcaacatggccaaggtgctggcgtccctcagtgatgacgaggacgaggaggaggaggaggaaggagaagaggaagaagaggaagcagaagaagaggaggaggaagatgaggaagaggaggaagaagaggaggaggaggaggaagaagagcctcagcagcgagggcagggagagaagtcagccacgccctcacggaagattctggaccctaacactggggagccagctcccgtgctgtcctccccacctcctgcagacgtctccaccttcctggcttttccctctccagagaagctgctgcgcctagggcccaagagctccgtgctgatagcccagcagactgacacgtctgaccccgagaaggtggtctctgccttcctaaaggtgtcatctgtgttcaaggacgaagctactgtgaggatggcagtgcaggatgcagtagatgccctgatgcagaaggctttcaactcctcgtccttcaactccaacaccttcctcaccaggctcctcgtgcacatgggtctgctcaagagtgaagacaaggtcaaggccattgccaacctgtacggccccctgatggcgctgaaccacatggtgcagcaggactatttccccaaggcccttgcacccctgctgctggcgttcgtgaccaagcccaacagcgccctggaatcctgctccttcgcccgccacagtctgctgcagacgctgtacaagtctggggagggagaggcagggtccccaatgtccgagctgcatctggacgctgctcttaaaggacctcctggggcaggggagcggtagggtctggactgggcagatgctgtatgacctccctgagcacccgtgactgccccatgctttcccctttgtgctctgtgtgtgtctgggctgtgcccgggggcttcacaaataaagtcgtgtggcagcttcagagactcagaaactctcactgaaagcgggatagtctcgggggccgttgtacgtggagtcccacctcggcagagcatgcggccccgcagcagtctgtggggcagtcagccctgcagaagggcccggcctcggcctcaggccactacctgggaagtggcagtcctgagtgggggcccattttcctgcctggccacacctcacccagcaccctgcctttgggctgcagctcgcttggcttctgcgttgctccttcactatggaagccacctcccttgggatcctttgctccactgccacatatgtgaggacagcccagccaaccttccttacctcctaccctacaccatgtatgtgctttgggagcccatgtcccccacaaacggcctccaagaagtccctccaaggtttcttagagggcaatattttctcattggcagtcggccacgtaggtgaccaggtggcagaggatactgctggccctgtcccctgtcttctgtgtgagttgatacggtagggggtgggtgtggggctggcattaagttctgatgccagctacaacgtggatgaactttgaaaacatgttaaatga

SEQ ID NO: 1044 - DNA, 3875 bp, Homo sapiens
ctgccggctttcaaaatcctcctcctccgccatcatccgccgcggtgcggagagcaggtggtgctggaagcgcgtgaggccgggagctcgagagagctaacagactagccggctggacatctggaccgctggatccggaggtggcgaccccggcctgacccggaccctaaatccgtccccgccccagagggcggaggcgcgcgctcgattccccccacgcggcggcgccgcctgtttacgagacggtctccttctgtcacccaggctggagtgtagtggaacgatcaccgctgaactgcagcgtcggcttcctgggctcaagcgatcctcccacctcaacctcccaagtcatggggactacagatgccatcacacctggctaatttttaaatttttctgtggagacagggtctcattctgttgcccaggcttgtctcgaaccctggtctaaagtgatcttcccgcctagcctcccaaaatgttggaattacagtctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatgctaaagatgtgattaaagagattgaagactttgacagcttggaggctctgcgtctggaaggcaacacagtgggcgtggaagcagccagggtcatcgccaaggccttagagaagaagtcggagttgaagcgctgccactggagtgacatgttcacgggaaggctgcggaccgagatcccaccagccctgatctcactaggggaaggactcatcacagctggggctcagctggtggagctggacttaagcgacaacgcattcgggcccgacggtgtgcaaggcttcgaggccctgctcaagagctcagcctgcttcaccctgcaggaactcaagctcaacaactgtggcatgggcattggcggcggcaagatcctggctgcagctctgaccgaatgtcaccggaaatccagtgcccaaggcaagcctctggccctgaaggtctttgtggctggcagaaaccgtctggagaatgatggcgccactgccttggcagaagcttttagggtcatcgggaccctggaggaggtccacatgccacagaatgggatcaaccaccctggcatcactgccctggcccaggctttcgctgtcaaccccctgctgcgggtcatcaacctgaatgacaacaccttcactgagaagggcgccgtggccatggccgagaccttgaagaccttgcggcaggtggaggtgattaattttggggactgcctggtgcgctccaagggtgcagttgccattgcagatgccatccgcggcggcctgcccaagctaaaggagctgaacttgtcattctgtgaaatcaagagggatgctgccctggctgttgctgaggccatggcagacaaagctgagctggagaagctggacctgaatggcaacaccctgggagaagaaggctgtgaacagcttcaggaggtgctggagggcttcaacatggccaaggtgctggcgtccctcagtgatgacgaggacgaggaggaggaggaggaaggagaagaggaagaagaggaagcagaagaagaggaggaggaagatgaggaagaggaggaagaagaggaggaggaggaggaagaagagcctcagcagcgagggcagggagagaagtcagccacgccctcacggaagattctggaccctaacactggggagccagctcccgtgctgtcctccccacctcctgcagacgtctccaccttcctggcttttccctctccagagaagctgctgcgcctagggcccaagagctccgtgctgatagcccagcagactgacacgtctgaccccgagaaggtggtctctgccttcctaaaggtgtcatctgtgttcaaggacgaagctactgtgaggatggcagtgcaggatgcagtagatgccctgatgcagaaggctttcaactcctcgtccttcaactccaacaccttcctcaccaggctcctcgtgcacatgggtctgctcaagagtgaagacaaggtcaaggccattgccaacctgtacggccccctgatggcgctgaaccacatggtgcagcaggactatttccccaaggcccttgcacccctgctgctggcgttcgtgaccaagcccaacagcgccctggaatcctgctccttcgcccgccacagtctgctgcagacgctgtacaaggtctagactcaaagcctctcccatcccttggcctggaccagtgagctggggagggactcggatgaactgaggcgcagcctacgccattgccttggacaggactctggccacaggcagggcgggtctgtgtcccatgtgtcctgtcagtcccctgagtatgtgtgtgggtgtggcgcatgtgcaggtctgtgcctcctgtcgggatttgggttttaacgtcttctgctggcccagccctgctctgttgtggggagttggcccccaggggaaagggctgtgagctgctccgccattaaactcacctccacctgagggcgctctgctgatctccgcctgggccctgatggccgtccccacccacctgccttccggcccggctccctggcggagccagaacccagggagttgcccgcgtgctgtccttcccctctgtgttgtgattgggttgtttcctgccctgcctggggctgcttctcgtcaccaagccctggtcctgcggcagctgtcacccctaccatccataccactgtgctgaccgctcagcctgaagagcagagaatgccatgggtgggactgtgggggtcggatcgtggggttgttggcagagggcaaccctgggccccacaccgtgtggacaggcagacaccagattgtccaggagcaggagctgctgggactgcgctggccccggacctagtgggccttctcctggctgctgagatgtcgtctgtgactggcctggctggagggggagtgttgacaacccaaagctgttctccagtctggggagggagaggcagggtccccaatgtccgagctgcatctggacgctgctcttaaaggacctcctggggcaggggagcggtagggtctggactgggcagatgctgtatgacctccctgagcacccgtgactgccccatgctttcccctttgtgctctgtgtgtgtctgggctgtgcccgggggcttcacaaataaagtcgtgtggcagcttcagagactcagaaactctcactgaaagcgggatagtctcgggggccgttgtacgtggagtcccacctcggcagagcatgcggccccgcagcagtctgtggggcagtcagccctgcagaagggcccggcctcggcctcaggccactacctgggaagtggcagtcctgagtgggggcccattttcctgcctggccacacctcacccagcaccctgcctttgggctgcagctcgcttggcttctgcgttgctccttcactatggaagccacctcccttgggatcctttgctccactgccacatatgtgaggacagcccagccaaccttccttacctcctaccctacaccatgtatgtgctttgggagcccatgtcccccacaaacggcctccaagaagtccctccaaggtttcttagagggcaatattttctcattggcagtcggccacgtaggtgaccaggtggcagaggatactgctggccctgtcccctgtcttctgtgtgagttgatacggtagggggtgggtgtggggctggcattaagttctgatgccagctacaacgtggatgaactttgaaaacatgttaaatga

SEQ ID NO: 1045 - DNA, 3622 bp, Homo sapiens
ctgccggctttcaaaatcctcctcctccgccatcatccgccgcggtgcggagagcaggtggtgctggaagcgcgtgaggccgggagctcgagagagctaacagactagccggctggacatctggaccgctggatccggaggtggcgaccccggcctgacccggaccctaaatccgtccccgccccagagggcggaggcgcgcgctcgattccccccacgcggcggcgccgcctgtttacgtctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatgctaaagatgtgattaaagagattgaagactttgacagcttggaggctctgcgtctggaaggcaacacagtgggcgtggaagcagccagggtcatcgccaaggccttagagaagaagtcggagttgaagcgctgccactggagtgacatgttcacgggaaggctgcggaccgagatcccaccagccctgatctcactaggggaaggactcatcacagctggggctcagctggtggagctggacttaagcgacaacgcattcgggcccgacggtgtgcaaggcttcgaggccctgctcaagagctcagcctgcttcaccctgcaggaactcaagctcaacaactgtggcatgggcattggcggcggcaagatcctggctgcagctctgaccgaatgtcaccggaaatccagtgcccaaggcaagcctctggccctgaaggtctttgtggctggcagaaaccgtctggagaatgatggcgccactgccttggcagaagcttttagggtcatcgggaccctggaggaggtccacatgccacagaatgggatcaaccaccctggcatcactgccctggcccaggctttcgctgtcaaccccctgctgcgggtcatcaacctgaatgacaacaccttcactgagaagggcgccgtggccatggccgagaccttgaagaccttgcggcaggtggaggtgattaattttggggactgcctggtgcgctccaagggtgcagttgccattgcagatgccatccgcggcggcctgcccaagctaaaggagctgaacttgtcattctgtgaaatcaagagggatgctgccctggctgttgctgaggccatggcagacaaagctgagctggagaagctggacctgaatggcaacaccctgggagaagaaggctgtgaacagcttcaggaggtgctggagggcttcaacatggccaaggtgctggcgtccctcagtgatgacgaggacgaggaggaggaggaggaaggagaagaggaagaagaggaagcagaagaagaggaggaggaagatgaggaagaggaggaagaagaggaggaggaggaggaagaagagcctcagcagcgagggcagggagagaagtcagccacgccctcacggaagattctggaccctaacactggggagccagctcccgtgctgtcctccccacctcctgcagacgtctccaccttcctggcttttccctctccagagaagctgctgcgcctagggcccaagagctccgtgctgatagcccagcagactgacacgtctgaccccgagaaggtggtctctgccttcctaaaggtgtcatctgtgttcaaggacgaagctactgtgaggatggcagtgcaggatgcagtagatgccctgatgcagaaggctttcaactcctcgtccttcaactccaacaccttcctcaccaggctcctcgtgcacatgggtctgctcaagagtgaagacaaggtcaaggccattgccaacctgtacggccccctgatggcgctgaaccacatggtgcagcaggactatttccccaaggcccttgcacccctgctgctggcgttcgtgaccaagcccaacagcgccctggaatcctgctccttcgcccgccacagtctgctgcagacgctgtacaaggtctagactcaaagcctctcccatcccttggcctggaccagtgagctggggagggactcggatgaactgaggcgcagcctacgccattgccttggacaggactctggccacaggcagggcgggtctgtgtcccatgtgtcctgtcagtcccctgagtatgtgtgtgggtgtggcgcatgtgcaggtctgtgcctcctgtcgggatttgggttttaacgtcttctgctggcccagccctgctctgttgtggggagttggcccccaggggaaagggctgtgagctgctccgccattaaactcacctccacctgagggcgctctgctgatctccgcctgggccctgatggccgtccccacccacctgccttccggcccggctccctggcggagccagaacccagggagttgcccgcgtgctgtccttcccctctgtgttgtgattgggttgtttcctgccctgcctggggctgcttctcgtcaccaagccctggtcctgcggcagctgtcacccctaccatccataccactgtgctgaccgctcagcctgaagagcagagaatgccatgggtgggactgtgggggtcggatcgtggggttgttggcagagggcaaccctgggccccacaccgtgtggacaggcagacaccagattgtccaggagcaggagctgctgggactgcgctggccccggacctagtgggccttctcctggctgctgagatgtcgtctgtgactggcctggctggagggggagtgttgacaacccaaagctgttctccagtctggggagggagaggcagggtccccaatgtccgagctgcatctggacgctgctcttaaaggacctcctggggcaggggagcggtagggtctggactgggcagatgctgtatgacctccctgagcacccgtgactgccccatgctttcccctttgtgctctgtgtgtgtctgggctgtgcccgggggcttcacaaataaagtcgtgtggcagcttcagagactcagaaactctcactgaaagcgggatagtctcgggggccgttgtacgtggagtcccacctcggcagagcatgcggccccgcagcagtctgtggggcagtcagccctgcagaagggcccggcctcggcctcaggccactacctgggaagtggcagtcctgagtgggggcccattttcctgcctggccacacctcacccagcaccctgcctttgggctgcagctcgcttggcttctgcgttgctccttcactatggaagccacctcccttgggatcctttgctccactgccacatatgtgaggacagcccagccaaccttccttacctcctaccctacaccatgtatgtgctttgggagcccatgtcccccacaaacggcctccaagaagtccctccaaggtttcttagagggcaatattttctcattggcagtcggccacgtaggtgaccaggtggcagaggatactgctggccctgtcccctgtcttctgtgtgagttgatacggtagggggtgggtgtggggctggcattaagttctgatgccagctacaacgtggatgaactttgaaaacatgttaaatga

SEQ ID NO: 1046 - DNA, 1764 bp, Homo sapiens
atggcctcggaagacattgccaagctggcagagacacttgccaagactcaggtggccgggggacagctgagtttcaaaggcaagagcctcaaactcaacactgcagaagatgctaaagatgtgattaaagagattgaagactttgacagcttggaggctctgcgtctggaaggcaacacagtgggcgtggaagcagccagggtcatcgccaaggccttagagaagaagtcggagttgaagcgctgccactggagtgacatgttcacgggaaggctgcggaccgagatcccaccagccctgatctcactaggggaaggactcatcacagctggggctcagctggtggagctggacttaagcgacaacgcattcgggcccgacggtgtgcaaggcttcgaggccctgctcaagagctcagcctgcttcaccctgcaggaactcaagctcaacaactgtggcatgggcattggcggcggcaagatcctggctgcagctctgaccgaatgtcaccggaaatccagtgcccaaggcaagcctctggccctgaaggtctttgtggctggcagaaaccgtctggagaatgatggcgccactgccttggcagaagcttttagggtcatcgggaccctggaggaggtccacatgccacagaatgggatcaaccaccctggcatcactgccctggcccaggctttcgctgtcaaccccctgctgcgggtcatcaacctgaatgacaacaccttcactgagaagggcgccgtggccatggccgagaccttgaagaccttgcggcaggtggaggtgattaattttggggactgcctggtgcgctccaagggtgcagttgccattgcagatgccatccgcggcggcctgcccaagctaaaggagctgaacttgtcattctgtgaaatcaagagggatgctgccctggctgttgctgaggccatggcagacaaagctgagctggagaagctggacctgaatggcaacaccctgggagaagaaggctgtgaacagcttcaggaggtgctggagggcttcaacatggccaaggtgctggcgtccctcagtgatgacgaggacgaggaggaggaggaggaaggagaagaggaagaagaggaagcagaagaagaggaggaggaagatgaggaagaggaggaagaagaggaggaggaggaggaagaagagcctcagcagcgagggcagggagagaagtcagccacgccctcacggaagattctggaccctaacactggggagccagctcccgtgctgtcctccccacctcctgcagacgtctccaccttcctggcttttccctctccagagaagctcctgcgcctagggcccaagagctccgtgctgatagcccagcagactgacacgtctgaccccgagaaggtggtctctgccttcctaaaggtgtcatctgtgttcaaggacgaagctactgtgaggatggcagtgcaggatgcagtagatgccctgatgcagaaggctttcaactcctcgtccttcaactccaacaccttcctcaccaggctcctcgtgcacatgggtctgctcaagagtgaagacaaggtcaaggccattgccaacctgtacggccccctgatggcgctgaaccacatggtgcagcaggactatttccccaaggcccttgcacccctgctgctggcgttcgtgaccaagcccaacagcgccctggaatcctgctccttcgcccgccacagtctgctgcagacgctgtacaaggtctag

SEQ ID NO: 1047 - DNA, 3382 bp, Homo sapiens
tctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatgctaaagatgtgattaaagagattgaagactttgacagcttggaggctctgcgtctggaaggcaacacagtgggcgtggaagcagccagggtcatcgccaaggccttagagaagaagtcggagttgaagcgctgccactggagtgacatgttcacgggaaggctgcggaccgagatcccaccagccctgatctcactaggggaaggactcatcacagctggggctcagctggtggagctggacttaagcgacaacgcattcgggcccgacggtgtgcaaggcttcgaggccctgctcaagagctcagcctgcttcaccctgcaggaactcaagctcaacaactgtggcatgggcattggcggcggcaagatcctggctgcagctctgaccgaatgtcaccggaaatccagtgcccaaggcaagcctctggccctgaaggtctttgtggctggcagaaaccgtctggagaatgatggcgccactgccttggcagaagcttttagggtcatcgggaccctggaggaggtccacatgccacagaatgggatcaaccaccctggcatcactgccctggcccaggctttcgctgtcaaccccctgctgcgggtcatcaacctgaatgacaacaccttcactgagaagggcgccgtggccatggccgagaccttgaagaccttgcggcaggtggaggtgattaattttggggactgcctggtgcgctccaagggtgcagttgccattgcagatgccatccgcggcggcctgcccaagctaaaggagctgaacttgtcattctgtgaaatcaagagggatgctgccctggctgttgctgaggccatggcagacaaagctgagctggagaagctggacctgaatggcaacaccctgggagaagaaggctgtgaacagcttcaggaggtgctggagggcttcaacatggccaaggtgctggcgtccctcagtgatgacgaggacgaggaggaggaggaggaaggagaagaggaagaagaggaagcagaagaagaggaggaggaagatgaggaagaggaggaagaagaggaggaggaggaggaagaagagcctcagcagcgagggcagggagagaagtcagccacgccctcacggaagattctggaccctaacactggggagccagctcccgtgctgtcctccccacctcctgcagacgtctccaccttcctggcttttccctctccagagaagctgctgcgcctagggcccaagagctccgtgctgatagcccagcagactgacacgtctgaccccgagaaggtggtctctgccttcctaaaggtgtcatctgtgttcaaggacgaagctactgtgaggatggcagtgcaggatgcagtagatgccctgatgcagaaggctttcaactcctcgtccttcaactccaacaccttcctcaccaggctcctcgtgcacatgggtctgctcaagagtgaagacaaggtcaaggccattgccaacctgtacggccccctgatggcgctgaaccacatggtgcagcaggactatttccccaaggcccttgcacccctgctgctggcgttcgtgaccaagcccaacagcgccctggaatcctgctccttcgcccgccacagtctgctgcagacgctgtacaaggtctagactcaaagcctctcccatcccttggcctggaccagtgagctggggagggactcggatgaactgaggcgcagcctacgccattgccttggacaggactctggccacaggcagggcgggtctgtgtcccatgtgtcctgtcagtcccctgagtatgtgtgtgggtgtggcgcatgtgcaggtctgtgcctcctgtcgggatttgggttttaacgtcttctgctggcccagccctgctctgttgtggggagttggcccccaggggaaagggctgtgagctgctccgccattaaactcacctccacctgagggcgctctgctgatctccgcctgggccctgatggccgtccccacccacctgccttccggcccggctccctggcggagccagaacccagggagttgcccgcgtgctgtccttcccctctgtgttgtgattgggttgtttcctgccctgcctggggctgcttctcgtcaccaagccctggtcctgcggcagctgtcacccctaccatccataccactgtgctgaccgctcagcctgaagagcagagaatgccatgggtgggactgtgggggtcggatcgtggggttgttggcagagggcaaccctgggccccacaccgtgtggacaggcagacaccagattgtccaggagcaggagctgctgggactgcgctggccccggacctagtgggccttctcctggctgctgagatgtcgtctgtgactggcctggctggagggggagtgttgacaacccaaagctgttctccagtctggggagggagaggcagggtccccaatgtccgagctgcatctggacgctgctcttaaaggacctcctggggcaggggagcggtagggtctggactgggcagatgctgtatgacctccctgagcacccgtgactgccccatgctttcccctttgtgctctgtgtgtgtctgggctgtgcccgggggcttcacaaataaagtcgtgtggcagcttcagagactcagaaactctcactgaaagcgggatagtctcgggggccgttgtacgtggagtcccacctcggcagagcatgcggccccgcagcagtctgtggggcagtcagccctgcagaagggcccggcctcggcctcaggccactacctgggaagtggcagtcctgagtgggggcccattttcctgcctggccacacctcacccagcaccctgcctttgggctgcagctcgcttggcttctgcgttgctccttcactatggaagccacctcccttgggatcctttgctccactgccacatatgtgaggacagcccagccaaccttccttacctcctaccctacaccatgtatgtgctttgggagcccatgtcccccacaaacggcctccaagaagtccctccaaggtttcttagagggcaatattttctcattggcagtcggccacgtaggtgaccaggtggcagaggatactgctggccctgtcccctgtcttctgtgtgagttgatacggtagggggtgggtgtggggctggcattaagttctgatgccagctacaacgtggatgaactttgaaaacatgttaaatga

SEQ ID NO: 1048 - DNA, 3719 bp, Homo sapiens
gccgcctgtttacggtagagtcagggtccctttcctttccccgtcacctgcctggaacaggggtgcggggcgaggagggcgtggcgcccgtgtgcgccttctgcctgccccctcggccttcttcacttagccttcgacggccgagcgccccaggggtggcggtgggagtggggttgttgagcggcgctggctcctttcacaaatggggaaactgaggcttaaagggcgtctgactcgccagagcagctcagcctgcagctgctagcagtggcgtctcatattagcattgttgtcaaccggaggcggtgcgagtccgccggggattccagatggggctcctgcgccgcccgcctatcatttgcggcctgtattcgcgcgtcgctcccgcagagccacctcccagcaggcccacgcccgcgggggccccgggctggcgccgctgtccctggaatcgattctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatgctaaagatgtgattaaagagattgaagactttgacagcttggaggctctgcgtctggaaggcaacacagtgggcgtggaagcagccagggtcatcgccaaggccttagagaagaagtcggagttgaagcgctgccactggagtgacatgttcacgggaaggctgcggaccgagatcccaccagccctgatctcactaggggaaggactcatcacagctggggctcagctggtggagctggacttaagcgacaacgcattcgggcccgacggtgtgcaaggcttcgaggccctgctcaagagctcagcctgcttcaccctgcaggaactcaagctcaacaactgtggcatgggcattggcggcggcaagatcctggctgcagctctgaccgaatgtcaccggaaatccagtgcccaaggcaagcctctggccctgaaggtctttgtggctggcagaaaccgtctggagaatgatggcgccactgccttggcagaagcttttagggtcatcgggaccctggaggaggtccacatgccacagaatgggatcaaccaccctggcatcactgccctggcccaggctttcgctgtcaaccccctgctgcgggtcatcaacctgaatgacaacaccttcactgagaagggcgccgtggccatggccgagaccttgaagaccttgcggcaggtggaggtgattaattttggggactgcctggtgcgctccaagggtgcagttgccattgcagatgccatccgcggcggcctgcccaagctaaaggagctgaacttgtcattctgtgaaatcaagagggatgctgccctggctgttgctgaggccatggcagacaaagctgagctggagaagctggacctgaatggtagcaacaccctgggagaagaaggctgtgaacagcttcaggaggtgctggagggcttcaacatggccaaggtgctggcgtccctcagtgatgacgaggacgaggaggaggaggaggaaggagaagaggaagaagaggaagcagaagaagaggaggaggaagatgaggaagaggaggaagaagaggaggaggaggaggaagaagagcctcagcagcgagggcagggagagaagtcagccacgccctcacggaagattctggaccctaacactggggagccagctcccgtgctgtcctccccacctcctgcagacgtctccaccttcctggcttttccctctccagagaagctgctgcgcctagggcccaagagctccgtgctgatagcccagcagactgacacgtctgaccccgagaaggtggtctctgccttcctaaaggtgtcatctgtgttcaaggacgaagctactgtgaggatggcagtgcaggatgcagtagatgccctgatgcagaaggctttcaactcctcgtccttcaactccaacaccttcctcaccaggctcctcgtgcacatgggtctgctcaaggcccaacagcgccctggaatcctgctccttcgcccgccacagtctgctgcagacgctgtacaaggtctagactcaaagcctctcccatcccttggcctggaccagtgagctggggagggactcggatgaactgaggcgcagcctacgccattgccttggacaggactctggccacaggcagggcgggtctgtgtcccatgtgtcctgtcagtcccctgagtatgtgtgtgggtgtggcgcatgtgcaggtctgtgcctcctgtcgggatttgggttttaacgtcttctgctggcccagccctgctctgttgtggggagttggcccccaggggaaagggctgtgagctgctccgccattaaactcacctccacctgagggcgctctgctgatctccgcctgggccctgatggccgtccccacccacctgccttccggcccggctccctggcggagccagaacccagggagttgcccgcgtgctgtccttcccctctgtgttgtgattgggttgtttcctgccctgcctggggctgcttctcgtcaccaagccctggtcctgcggcagctgtcacccctaccatccataccactgtgctgaccgctcagcctgaagagcagagaatgccatgggtgggactgtgggggtcggatcgtggggttgttggcagagggcaaccctgggccccacaccgtgtggacaggcagacaccagattgtccaggagcaggagctgctgggactgcgctggccccggacctagtgggccttctcctggctgctgagatgtcgtctgtgactggcctggctggagggggagtgttgacaacccaaagctgttctccagtctggggagggagaggcagggtccccaatgtccgagctgcatctggacgctgctcttaaaggacctcctggggcaggggagcggtagggtctggactgggcagatgctgtatgacctccctgagcacccgtgactgccccatgctttcccctttgtgctctgtgtgtgtctgggctgtgcccgggggcttcacaaataaagtcgtgtggcagcttcagagactcagaaactctcactgaaagcgggatagtctcgggggccgttgtacgtggagtcccacctcggcagagcatgcggccccgcagcagtctgtggggcagtcagccctgcagaagggcccggcctcggcctcaggccactacctgggaagtggcagtcctgagtgggggcccattttcctgcctggccacacctcacccagcaccctgcctttgggctgcagctcgcttggcttctgcgttgctccttcactatggaagccacctcccttgggatcctttgctccactgccacatatgtgaggacagcccagccaaccttccttacctcctaccctacaccatgtatgtgctttgggagcccatgtcccccacaaacggcctccaagaagtccctccaaggtttcttagagggcaatattttctcattggcagtcggccacgtaggtgaccaggtggcagaggatactgctggccctgtcccctgtcttctgtgtgagttgatacggtagggggtgggtgtggggctggcattaagttctgatgccagctacaacgtggatgaactttgaaaacatgttaaatga

SEQ ID NO: 1049 - DNA, 2423 bp, Homo sapiens
gaattccggctagaaatgaatatgtaagaaagcttatagtagtttaaatcatttgtagaaccagccgagtttctcaagtcgcctccagaccgcagacatgaaacttgtcttcctcgtcctgctgttcctcggggccctcggactgtgtctggctggccgtaggagaaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgaggcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgttgctccaccaacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcaggaagtaaaaccgaagaagatggcccagctccccaagaaagcctcagccattcactgcccccagctcttctccccaggtgtgttgggccttggcctcccctgctgaaggtggggattgcccatccatctgcttacaattccctgctgtcgtcttagcaagaagtaaaatgagaaattttgttgtatattctctcctta

SEQ ID NO: 1050 - DNA, 2902 bp, Homo sapiens
gactcctaggggcttgcagactagtgggagagaaagaacatcgcagcagccaggcagaaccaggacaggtgaggtgcaggctggctttcctctcgcagcgcggtgtggagtcctgtcctgcctcagggcttttcggagcctggatcctcaaggaacaagtagacctggccgcggggagtggggagggaaggggtgtctattgggcaacagggcggggcaaagccctgaataaaggggcgcagggcaggcgcaagtggcagagccttcgtttgccaagtcgcctccagaccgcagacatgaaacttgtcttcctcgtcctgctgttcctcggggccctcggactgtgtctggctggccgtaggagaaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgacgcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgttgctccaccaacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcaggaagtaaaaccgaagaagatggcccagctccccaagaaagcctcagccattcactgcccccagctcttctccccaggtgtgttggggccttggcctcccctgctgaaggtggggattgcccatccatctgcttacaattccctgctgtcgtcttagcaagaagtaaaatgagaaattttgttgatattctctccttataaagtgtcactcatcttttctagaattttatactgaaatcacatgcctgacaaaatacctgtacagttggaccttcccttccaagtttttcaggtccagcccctcctctttcttgcagtcttgggtatgatgcccaagggtctggaatttaaggccaggccaagcaccggttttcctaaggggatcttgttggttattcacatagctgtctcagtgcacgtgcatgtatgtgcctgggagtgtgtgcgtgtccccaaggcagggcaggaagagcaagca

SEQ ID NO: 1051 - DNA, 2619 bp, Homo sapiens
gactcctaggggcttgcagacctagtgggagagaaagaacatcgcagcagccaggcagaaccaggacaggtgaggtgcaggctggctttcctctcgcagcgcggtgtggagtcctgtcctgcctcagggcttttcggagcctggatcctcaaggaacaagtagacctggccgcggggagtggggagggaaggggtgtctattgggcaacagggcggcaaagccctgaataaaggggcgcagggcaggcgcaagtgcagagccttcgtttgccaagtcgcctccagaccgcagacatgaaacttgtcttcctcgtcctgctgttcctcggggccctcggactgtgtctggctggccgtaggagaaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctacagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcatgcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgaggcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgctgctccaccaacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcaggaagtaaaaccgaagaagatggcccagctccccaagaaagcctcagccattcactgcccccagctcttctccccaggtgtgttggggccttggctcccctgctgaaggtggggattgcccatccatctgcttacaattccctgctgtcgtcttagcaagaagtaaaatgagaaattttgttgatattcaaaaaaaa

SEQ ID NO: 1052 - DNA, 321 bp, Homo sapiens
atgctccttcacccactgagtagctgcagcgatgctctccatcttggtaacatccagggtcaccgtctccagcctgtcagacgtctggcccctcagctgctcggcccccttctccgtcagacacgcagccagcactctcaagcctcgtgcatccagctgtctggccagcaggttcccaaagcccgagtcacagcccgtgataaagacatacttgtcttggaggtggctcaccacctgcctctcccggtaccagtgcagaaggtagtacaggcccacgaaggccgccaggtagagccacatagtgagggtgcttccttctct

SEQ ID NO: 1053 - DNA, 822 bp, Homo sapiens
gcttgtaaacatataacataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagagggaccatatgatgtggtggttctaccaggaggtaatctgggcgcacagaatttatctgagtctgctgctgtgaaggagatactgaaggagcaggaaaaccggaagggcctgatagccgccatctgtgcaggtcctactgctctgttggctcatgaaataggttttggaagtaaagttacaacacaccctcttgctaaagacaaaatgatgaatggaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaacaaaacagtggtaggttaatgtgttcagaagtcgctgtccttactacttttgcggaagtatggaagtcacaactacacagagatttctcagcctacaaattgtgtctatacatttctaagccttgtttgcagaataaacagggcatttagcaaactac

SEQ ID NO: 1054 - DNA, 911 bp, Homo sapiens
tggcgtgcgttcattttcagcctggtgtggggtgagtggtacccaacgggccggggcgccgcgtccgcaggaagaggcgcggggtgcaggcttgtaaacatataacataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagagggaccatatgatgtggtggttctaccaggaggtaatctgggcgcacagaatttatctgagtctgctgctgtgaaggagatactgaaggagcaggaaaaccggaagggcctgatagccgccatctgtgcaggtcctactgctctgttggctcatgaaataggttttggaagtaaagttacaacacaccctcttgctaaagacaaaatgatgaatggaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaacaaaacagtggtaggttaatgtgttcagaagtcgctgtccttactacttttgcggaagtatggaagtcacaactacacagagatttctcagcctacaaattgtgtctatacatttctaagccttgtttgcagaataaacagggcatttagcaaactac

SEQ ID NO: 1055 - DNA, 13235 bp, Homo sapiens
atggcgggctccggagccggtgtgcgttgctccctgctgcggctgcaggagaccttgtccgctgcggaccgctgcggtgctgccctggccggtcatcaactgatccgcggcctggggcaggaatgcgtcctgagcagcagccccgcggtgctggcattacagacatctttagttttttccagagatttcggtttgcttgtatttgtccggaagtcactcaacagtattgaatttcgtgaatgtagagaagaaatcctaaagtttttatgtattttcttagaaaaaatgggccagaagatcgcaccttactctgttgaaattaagaacacttgtaccagtgtttatacaaaagatagagctgctaaatgtaaaattccagccctggaccttcttattaagttacttcagacttttagaagttctagactcatggatgaatttaaaattggagaattatttagtaaattctatggagaacttgcattgaaaaaaaaaataccagatacagttttagaaaaagtatatgagctcctaggattattgggtgaagttcatcctagtgagatgataaataatgcagaaaacctgttccgcgcttttctgggtgaacttaagacccagatgacatcagcagtaagagagcccaaactacctgttctggcaggatgtctgaaggggttgtcctcacttctgtgcaacttcactaagtccatggaagaagatccccagacttcaagggagatttttaattttgtactaaaggcaattcgtcctcagattgatctgaagagatatgctgtgccctcagctggcttgcgcctatttgccctgcatgcatctcagtttagcacctgccttctggacaactacgtgtctctatttgaagtcttgttaaagtggtgtgcccacacaaatgtagaattgaaaaaagctgcactttcagccctggaatcctttctgaaacaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggaccgtgcaaggttataaacgcaaaagatgttgacttcatgtacgttgagctcattcagcgctgcaagcagatgttcctcacccagacagacactggtgacgaccgtgtttatcagatgccaagcttcctccagtctgttgcaagcgtcttgctgtaccttgacacagttcctgaggtgtatactccagttctggagcacctcgtggtgatgcagatagacagtttcccacagtacagtccaaaaatgcagctggtgtgttgcagagccatagtgaaggtgttcctagctttggcagcaaaagggccagttctcaggaattgcattagtactgtggtgcatcagggtttaatcagaatatgttctaaaccagtggtccttccaaagggccctgagtctgaatctgaagaccaccgtgcttcaggggaagtcagaactggcaaatggaaggtgcccacatacaaagactacgtggatctcttcagacatctcctgagctctgaccagatgatggattctattttagcagatgaagcatttttctctgtgaattcctccagtgaaagtctgaatcatttactttatgatgaatttgtaaaatccgttttgaagattgttgagaaattggatcttacacttgaaatacagactgttggggaacaagagaatggagatgaggcgcctggtgtttggatgatcccaacttcagatccagcggctaacttgcatccagctaaacctaaagatttttcggctttcattaacctggtggaattttgcagagagattctccctgagaaacaagcagaattttttgaaccatgggtgtactcattttcatatgaattaattttgcaatctacaaggttgcccctcatcagtggtttctacaaattgctttctattacagtaagaaatgccaagaaaataaaatatttcgagggagttagtccaaagagtctgaaacactctcctgaagacccagaaaagtattcttgctttgctttatttgtgaaatttggcaaagaggtggcagttaaaatgaagcagtacaaagatgaacttttggcctcttgtttgacctttcttctgtccttgccacacaacatcattgaactcgatgttagagcctacgttcctgcactgcagatggctttcaaactgggcctgagctatacccccttggcagaagtaggcctgaatgctctagaagaatggtcaatttatattgacagacatgtaatgcagccttattacaaagacattctcccctgcctggatggatacctgaagacttcagccttgtcagatgagaccaagaataactgggaagtgtcagctctttctcgggctgcccagaaaggatttaataaagtggtgttaaagcatctgaagaagacaaagaacctttcatcaaacgaagcaatatccttagaagaaataagaattagagtagtacaaatgcttggatctctaggaggacaaataaacaaaaatcttctgacagtcacgtcctcagatgagatgatgaagagctatgtggcctgggacagagagaagcggctgagctttgcagtgccctttagagagatgaaacctgtcattttcctggatgtgttcctgcctcgagtcacagaattagcgctcacagccagtgacagacaaactaaagttgcagcctgtgaacttttacatagcatggttatgtttatgttgggcaaagccacgcagatgccagaagggggacagggagccccacccatgtaccagctctataagcggacgtttcctgtgctgcttcgacttgcgtgtgatgttgatcaggtgacaaggcaactgtatgagccactagttatgcagctgattcactggttcactaacaacaagaaatttgaaagtcaggatactgttgccttactagaagctatattggatggaattgtggaccctgttgacagtactttaagagatttttgtggtcggtgtattcgagaattccttaaatggtccattaagcaaataacaccacagcagcaggagaagagtccagtaaacaccaaatcgcttttcaagcgactttatagccttgcgcttcaccccaatgctttcaagaggctgggagcatcacttgcctttaataatatctacagggaattcagggaagaagagtctctggtggaacagtttgtgtttgaagccttggtgatatacatggagagtctggccttagcacatgcagatgagaagtccttaggtacaattcaacagtgttgtgatgccattgatcacctatgccgcatcattgaaaagaagcatgtttctttaaataaagcaaagaaacgacgtttgccgcgaggatttccaccttccgcatcattgtgtttattggatctggtcaagtggcttttagctcattgtgggaggccccagacagaatgtcgacacaaatccattgaactcttttataaattcgttcctttattgccaggcaacagatcccctaatttgtggctgaaagatgttctcaaggaagaaggtgtctcttttctcatcaacacctttgaggggggtggctgtggccagccctcgggcatcctggcccagcccaccctcttgtaccttcgggggccattcagcctgcaggccacgctatgctggctggacctgctcctggccgcgttggagtgctacaacacgttcattggcgagagaactgtaggagcgctccaggtcctaggtactgaagcccagtcttcacttttgaaagcagtggctttcttcttagaaagcattgccatgcatgacattatagcagcagaaaagtgctttggcactggggcagcaggtaacagaacaagcccacaagagggagaaaggtacaactacagcaaatgcaccgttgtggtccggattatggagtttaccacgactctgctaaacacctccccggaaggatggaagctcctgaagaaggacttgtgtaatacacacctgatgagagtcctggtgcagacgctgtgtgagcccgcaagcataggtttcaacatcggagacgtccaggttatggctcatcttcctgatgtttgtgtgaatctgatgaaagctctaaagatgtccccatacaaagatatcctagagacccatctgagagagaaaataacagcacagagcattgaggagctttgtgccgtcaacttgtatggccctgacgcgcaagtggacaggagcaggctggctgctgttgtgtctgcctgtaaacagcttcacagagctgggcttctgcataatatattaccgtctcagtccacagatttgcatcattctgttggcacagaacttctttccctggtttataaaggcattgcccctggagatgagagacagtgtctgccttctctagacctcagttgtaagcagctggccagcggacttctggagttagcctttgcttttggaggactgtgtgagcgccttgtgagtcttctcctgaacccagcggtgctgtccacggcgtccttgggcagctcacagggcagcgtcatccacttctcccatggggagtatttctatagcttgttctcagaaacgatcaacacggaattattgaaaaatctggatcttgctgtattggagctcatgcagtcttcagtggataataccaaaatggtgagtgccgttttgaacggcatgttagaccagagcttcagggagcgagcaaaccagaaacaccaaggactgaaacttgcgactacaattctgcaacactggaagaagtgtgattcatggtgggccaaagattcccctctcgaaactaaaatggcagtgctggccttactggcaaaaattttacagattgattcatctgtatcttttaatacaagtcatggttcattccctgaagtctttacaacatatattagtctacttgctgacacaaagctggatctacatttaaagggccaagctgtcactcttcttccattcttcaccagcctcactggaggcagtctggaggaacttagacgtgttctggagcagctcatcgttgctcacttccccatgcagtccagggaatttcctccaggaactccgcggttcaataattatgtggactgcatgaaaaagtttctagatgcattggaattatctcaaagccctatgttgttggaattgatgacagaagttctttgtcgggaacagcagcatgtcatggaagaattatttcaatccagtttcaggaggattgccagaaggggttcatgtgtcacacaagtaggccttctggaaagcgtgtatgaaatgttcaggaaggatgacccccgcctaagtttcacacgccagtcctttgtggaccgctccctcctcactctgctgtggcactgtagcctggatgctttgagagaattcttcagcacaattgtggtggatgccattgatgtgttgaagtccaggtttacaaagctaaatgaatctacctttgatactcaaatcaccaagaagatgggctactataagattctagacgtgatgtattctcgccttcccaaagatgatgttcatgctaaggaatcaaaaattaatcaagttttccatggctcgtgtattacagaaggaaatgaacttacaaagacattgattaaattgtgctacgatgcatttacagagaacatggcaggagagaatcagctgctggagaggagaagactttaccattgtgcagcatacaactgcgccatatctgtcatctgctgtgtcttcaatgagttaaaattttaccaaggttttctgtttagtgaaaaaccagaaaagaacttgcttatttttgaaaatctgatcgacctgaagcgccgctataattttcctgtagaagttgaggttcctatggaaagaaagaaaaagtacattgaaattaggaaagaagccagagaagcagcaaatggggattcagatggtccttcctatatgtcttccctgtcatatttggcagacagtaccctgagtgaggaaatgagtcaatttgatttctcaaccggagttcagagctattcatacagctcccaagaccctagacctgccactggtcgttttcggagacgggagcagcgggaccccacggtgcatgatgatgtgctggagctggagatggacgagctcaatcggcatgagtgcatggcgcccctgacggccctggtcaagcacatgcacagaagcctgggcccgcctcaaggagaagaggattcagtgccaagagatcttccttcttggatgaaattcctccatggcaaactgggaaatccaatagtaccattaaatatccgtctcttcttagccaagcttgttattaatacagaagaggtctttcgcccttacgcgaagcactggcttagccccttgctgcagctggctgcttctgaaaacaatggaggagaaggaattcactacatggtggttgagatagtggccactattctttcatggacaggcttggccactccaacaggggtccctaaagatgaagtgttagcaaatcgattgcttaatttcctaatgaaacatgtctttcatccaaaaagagctgtgtttagacacaaccttgaaattataaagacccttgtcgagtgctggaaggattgtttatccatcccttataggttaatatttgaaaagttttccggtaaagatcctaattctaaagacaactcagtagggattcaattgctaggcatcgtgatggccaatgacctgcctccctatgacccacagtgtggcatccagagtagcgaatacttccaggctttggtgaataatatgtcctttgtaagatataaagaagtgtatgccgctgcagcagaagttctaggacttatacttcgatatgttatggagagaaaaaacatactggaggagtctctgtgtgaactggttgcgaaacaattgaagcaacatcagaatactatggaggacaagtttattgtgtgcttgaacaaagtgaccaagagcttccctcctcttgcagacaggttcatgaatgctgtgttctttctgctgccaaaatttcatggagtgttgaaaacactctgtctggaggtggtactttgtcgtgtggagggaatgacagagctgtacttccagttaaagagcaaggacttcgttcaagtcatgagacatagagatgatgaaagacaaaaagtatgtttggacataatttataagatgatgccaaagttaaaaccagtagaactccgagaacttctgaaccccgttgtggaattcgtttcccatccttctacaacatgtagggaacaaatgtataatattctcatgtggattcatgataattacagagatccagaaagtgagacagataatgactcccaggaaatatttaagttggcaaaagatgtgctgattcaaggattgatcgatgagaaccctggacttcaattaattattcgaaatttctggagccatgaaactaggttaccttcaaataccttggaccggttgctggcactaaattccttatattctcctaagatagaagtgcactttttaagtttagcaacaaattttctgctcgaaatgaccagcatgagcccagattatccaaaccccatgttcgagcatcctctgtcagaatgcgaatttcaggaatataccattgattctgattggcgtttccgaagtactgttctcactccgatgtttgtggagacccaggcctcccagggcactctccagacccgtacccaggaagggtccctctcagctcgctggccagtggcagggcagataagggccacccagcagcagcatgacttcacactgacacagactgcagatggaagaagctcatttgattggctgaccgggagcagcactgacccgctggtcgaccacaccagtccctcatctgactccttgctgtttgcccacaagaggagtgaaaggttacagagagcacccttgaagtcagtggggcctgattttgggaaaaaaaggctgggccttccaggggacgaggtggataacaaagtgaaaggtgcggccggccggacggacctactacgactgcgcagacggtttatgagggaccaggagaagctcagtttgatgtatgccagaaaaggcgttgctgagcaaaaacgagagaaggaaatcaagagtgagttaaaaatgaagcaggatgcccaggtcgttctgtacagaagctaccggcacggagaccttcctgacattcagatcaagcacagcagcctcatcaccccgttacaggccgtggcccagagggacccaataattgcaaaacagctctttagcagcttgttttctggaattttgaaagagatggataaatttaagacactgtctgaaaaaaacaacatcactcaaaagttgcttcaagacttcaatcgttttcttaataccaccttctctttctttccaccctttgtctcttgtattcaggacattagctgtcagcacgcagccctgctgagcctcgacccagcggctgttagcgctggttgcctggccagcctacagcagcccgtgggcatccgcctgctagaggaggctctgctccgcctgctgcctgctgagctgcctgccaagcgagtccgtgggaaggcccgcctccctcctgatgtcctcagatgggtggagcttgctaagctgtatagatcaattggagaatacgacgtcctccgtgggatttttaccagtgagataggaacaaagcaaatcactcagagtgcattattagcagaagccagaagtgattattctgaagctgctaagcagtatgatgaggctctcaataaacaagactgggtagatggtgagcccacagaagccgagaaggatttttgggaacttgcatcccttgactgttacaaccaccttgctgagtggaaatcacttgaatactgttctacagccagtatagacagtgagaaccccccagacctaaataaaatctggagtgaaccattttatcaggaaacatatctaccttacatgatccgcagcaagctgaagctgctgctccagggagaggctgaccagtccctgctgacatttattgacaaagctatgcacggggagctccagaaggcgattctagagcttcattacagtcaagagctgagtctgctttacctcctgcaagatgatgttgacagagccaaatattacattcaaaatggcattcagagttttatgcagaattattctagtattgatgtcctcttacaccaaagtagactcaccaaattgcagtctgtacaggctttaacagaaattcaggagttcatcagctttataagcaaacaaggcaatttatcatctcaagttccccttaagagacttctgaacacctggacaaacagatatccagatgctaaaatggacccaatgaacatctgggatgacatcatcacaaatcgatgtttctttctcagcaaaatagaggagaagcttacccctcttccagaagataatagtatgaatgtggatcaagatggagaccccagtgacaggatggaagtgcaagagcaggaagaagatatcagctccctgatcaggagttgcaagttttccatgaaaatgaagatgatagacagtgcccggaagcagaacaatttctcacttgctatgaaactactgaaggagctgcataaagagtcaaaaaccagagacgattggctggtgagctgggtgcagagctactgccgcctgagccactgccggagccggtcccagggctgctctgagcaggtgctcactgtgctgaaaacagtctctttgttggatgagaacaacgtgtcaagctacttaagcaaaaatattctggctttccgtgaccagaacattctcttgggtacaacttacaggatcatagcgaatgctctcagcagtgagccagcctgccttgctgaaatcgaggaggacaaggctagaagaatcttagagctttctggatccagttcagaggattcagagaaggtgatcgcgggtctgtaccagagagcattccagcacctctctgaggctgtgcaggcggctgaggaggaggcccagcctccctcctggagctgtgggcctgcagctggggtgattgatgcttacatgacgctggcagatttctgtgaccaacagctgcgcaaggaggaagagaatgcatcagttattgattctgcagaactgcaggcgtatccagcacttgtggtggagaaaatgttgaaagctttaaaattaaattccaatgaagccagattgaagtttcctagattacttcagattatagaacggtatccagaggagactttgagcctcatgacaaaagagatctcttccgttccctgctggcagttcatcagctggatcagccacatggtggccttactggacaaagaccaagccgttgctgttcagcactctgtggaagaaatcactgataactacccgcaggctattgtttatcccttcatcataagcagcgaaagctattccttcaaggatacttctactggtcataagaataaggagtttgtggcaaggattaaaagtaagttggatcaaggaggagtgattcaagattttattaatgccttagatcagctctctaatcctgaactgctctttaaggattggagcaatgatgtaagagctgaactagcaaaaacccctgtaaataaaaaaaacattgaaaaaatgtatgaaagaatgtatgcagccttgggtgacccaaaggctccaggcctgggggcctttagaaggaagtttattcagacttttggaaaagaatttgataaacattttgggaaaggaggttctaaactactgagaatgaagctcagtgacttcaacgacattaccaacatgctacttttaaaaatgaacaaagactcaaagccccctgggaatctgaaagaatgttcaccctggatgagcgacttcaaagtggagttcctgagaaatgagctggagattcccggtcagtatgacggtaggggaaagccattgccagagtaccacgtgcgaatcgccgggtttgatgagcgggtagtcatggcgtctctgcgaaggcccaagcgcatcatcatccgtggccatgacgagagggaacaccctttcctggtgaagggtggcgaggacctgcggcaggaccagcgcgtggagcagctcttccaggtcatgaatgggatcctggcccaagactccgcctgcagccagagggccctgcagctgaggacctatagcgttgtgcccatgacctccaggttaggattaattgagtggcttgaaaatactgttaccttgaaggaccttcttttgaacaccatgtcccaagaggagaaggcggcttacctgagtgatcccagggcaccgccgtgtgaatataaagattggctgacaaaaatgtcaggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggtttgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaagatacataaaagtgctttgcattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgat

SEQ ID NO: 1056 - DNA, 13509 bp, Homo sapiens
ggggcatttccgggtccgggccgagcgggcgcacgcgcgggagcgggactcggcggcatggcgggctccggagccggtgtgcgttgctccctgctgcggctgcaggagaccttgtccgctgcggaccgctgcggtgctgccctggccggtcatcaactgatccgcggcctggggcaggaatgcgtcctgagcagcagccccgcggtgctggcattacagacatctttagttttttccagagatttcggtttgcttgtatttgtccggaagtcactcaacagtattgaatttcgtgaatgtagagaagaaatcctaaagtttttatgtattttcttagaaaaaatgggccagaagatcgcaccttactctgttgaaattaagaacacttgtaccagtgtttatacaaaagatagagctgctaaatgtaaaattccagccctggaccttcttattaagttacttcagacttttagaagttctagactcatggatgaatttaaaattggagaattatttagtaaattctatggagaacttgcattgaaaaaaaaaataccagatacagttttagaaaaagtatatgagctcctaggattattgggtgaagttcatcctagtgagatgataaataatgcagaaaacctgttccgcgcttttctgggtgaacttaagacccagatgacatcagcagtaagagagcccaaactacctgttctggcaggatgtctgaaggggttgtcctcacttctgtgcaacttcactaagtccatggaagaagatccccagacttcaagggagatttttaattttgtactaaaggcaattcgtcctcagattgatctgaagagatatgctgtgccctcagctggcttgcgcctatttgccctgcatgcatctcagtttagcacctgccttctggacaactacgtgtctctatttgaagtcttgttaaagtggtgtgcccacacaaatgtagaattgaaaaaagctgcactttcagccctggaatcctttctgaaacaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggaccgtgcaaggttataaacgcaaaagatgttgacttcatgtacgttgagctcattcagcgctgcaagcagatgttcctcacccagacagacactggtgacgaccgtgtttatcagatgccaagcttcctccagtctgttgcaagcgtcttgctgtaccttgacacagttcctgaggtgtatactccagttctggagcacctcgtggtgatgcagatagacagtttcccacagtacagtccaaaaatgcagctggtgtgttgcagagccatagtgaaggtgttcctagctttggcagcaaaagggccagttctcaggaattgcattagtactgtggtgcatcagggtttaatcagaatatgttctaaaccagtggtccttccaaagggccctgagtctgaatctgaagaccaccgtgcttcaggggaagtcagaactggcaaatggaaggtgcccacatacaaagactacgtggatctcttcagacatctcctgagctctgaccagatgatggattctattttagcagatgaagcatttttctctgtgaattcctccagtgaaagtctgaatcatttactttatgatgaatttgtaaaatccgttttgaagattgttgagaaattggatcttacacttgaaatacagactgttggggaacaagagaatggagatgaggcgcctggtgtttggatgatcccaacttcagatccagcggctaacttgcatccagctaaacctaaagatttttcggctttcattaacctggtggaattttgcagagagattctccctgagaaacaagcagaattttttgaaccatgggtgtactcattttcatatgaattaattttgcaatctacaaggttgcccctcatcagtggtttctacaaattgctttctattacagtaagaaatgccaagaaaataaaatatttcgagggagttagtccaaagagtctgaaacactctcctgaagacccagaaaagtattcttgctttgctttatttgtgaaatttggcaaagaggtggcagttaaaatgaagcagtacaaagatgaacttttggcctcttgtttgacctttcttctgtccttgccacacaacatcattgaactcgatgttagagcctacgttcctgcactgcagatggctttcaaactgggcctgagctatacccccttggcagaagtaggcctgaatgctctagaagaatggtcaatttatattgacagacatgtaatgcagccttattacaaagacattctcccctgcctggatggatacctgaagacttcagccttgtcagatgagaccaagaataactgggaagtgtcagctctttctcgggctgcccagaaaggatttaataaagtggtgttaaagcatctgaagaagacaaagaacctttcatcaaacgaagcaatatccttagaagaaataagaattagagtagtacaaatgcttggatctctaggaggacaaataaacaaaaatcttctgacagtcacgtcctcagatgagatgatgaagagctatgtggcctgggacagagagaagcggctgagctttgcagtgccctttagagagatgaaacctgtcattttcctggatgtgttcctgcctcgagtcacagaattagcgctcacagccagtgacagacaaactaaagttgcagcctgtgaacttttacatagcatggttatgtttatgttgggcaaagccacgcagatgccagaagggggacagggagccccacccatgtaccagctctataagcggacgtttcctgtgctgcttcgacttgcgtgtgatgttgatcaggtgacaaggcaactgtatgagccactagttatgcagctgattcactggttcactaacaacaagaaatttgaaagtcaggatactgttgccttactagaagctatattggatggaattgtggaccctgttgacagtactttaagagatttttgtggtcggtgtattcgagaattccttaaatggtccattaagcaaataacaccacagcagcaggagaagagtccagtaaacaccaaatcgcttttcaagcgactttatagccttgcgcttcaccccaatgctttcaagaggctgggagcatcacttgcctttaataatatctacagggaattcagggaagaagagtctctggtggaacagtttgtgtttgaagccttggtgatatacatggagagtctggccttagcacatgcagatgagaagtccttaggtacaattcaacagtgttgtgatgccattgatcacctatgccgcatcattgaaaagaagcatgtttctttaaataaagcaaagaaacgacgtttgccgcgaggatttccaccttccgcatcattgtgtttattggatctggtcaagtggcttttagctcattgtgggaggccccagacagaatgtcgacacaaatccattgaactcttttataaattcgttcctttattgccaggcaacagatcccctaatttgtggctgaaagatgttctcaaggaagaaggtgtctcttttctcatcaacacctttgaggggggtggctgtggccagccctcgggcatcctggcccagcccaccctcttgtaccttcgggggccattcagcctgcaggccacgctatgctggctggacctgctcctggccgcgttggagtgctacaacacgttcattggcgagagaactgtaggagcgctccaggtcctaggtactgaagcccagtcttcacttttgaaagcagtggctttcttcttagaaagcattgccatgcatgacattatagcagcagaaaagtgctttggcactggggcagcaggtaacagaacaagcccacaagagggagaaaggtacaactacagcaaatgcaccgttgtggtccggattatggagtttaccacgactctgctaaacacctccccggaaggatggaagctcctgaagaaggacttgtgtaatacacacctgatgagagtcctggtgcagacgctgtgtgagcccgcaagcataggtttcaacatcggagacgtccaggttatggctcatcttcctgatgtttgtgtgaatctgatgaaagctctaaagatgtccccatacaaagatatcctagagacccatctgagagagaaaataacagcacagagcattgaggagctttgtgccgtcaacttgtatggccctgacgcgcaagtggacaggagcaggctggctgctgttgtgtctgcctgtaaacagcttcacagagctgggcttctgcataatatattaccgtctcagtccacagatttgcatcattctgttggcacagaacttctttccctggtttataaaggcattgcccctggagatgagagacagtgtctgccttctctagacctcagttgtaagcagctggccagcggacttctggagttagcctttgcttttggaggactgtgtgagcgccttgtgagtcttctcctgaacccagcggtgctgtccacggcgtccttgggcagctcacagggcagcgtcatccacttctcccatggggagtatttctatagcttgttctcagaaacgatcaacacggaattattgaaaaatctggatcttgctgtattggagctcatgcagtcttcagtggataataccaaaatggtgagtgccgttttgaacggcatgttagaccagagcttcagggagcgagcaaaccagaaacaccaaggactgaaacttgcgactacaattctgcaacactggaagaagtgtgattcatggtgggccaaagattcccctctcgaaactaaaatggcagtgctggccttactggcaaaaattttacagattgattcatctgtatcttttaatacaagtcatggttcattccctgaagtctttacaacatatattagtctacttgctgacacaaagctggatctacatttaaagggccaagctgtcactcttcttccattcttcaccagcctcactggaggcagtctggaggaacttagacgtgttctggagcagctcatcgttgctcacttccccatgcagtccagggaatttcctccaggaactccgcggttcaataattatgtggactgcatgaaaaagtttctagatgcattggaattatctcaaagccctatgttgttggaattgatgacagaagttctttgtcgggaacagcagcatgtcatggaagaattatttcaatccagtttcaggaggattgccagaaggggttcatgtgtcacacaagtaggccttctggaaagcgtgtatgaaatgttcaggaaggatgacccccgcctaagtttcacacgccagtcctttgtggaccgctccctcctcactctgctgtggcactgtagcctggatgctttgagagaattcttcagcacaattgtggtggatgccattgatgtgttgaagtccaggtttacaaagctaaatgaatctacctttgatactcaaatcaccaagaagatgggctactataagattctagacgtgatgtattctcgccttcccaaagatgatgttcatgctaaggaatcaaaaattaatcaagttttccatggctcgtgtattacagaaggaaatgaacttacaaagacattgattaaattgtgctacgatgcatttacagagaacatggcaggagagaatcagctgctggagaggagaagactttaccattgtgcagcatacaactgcgccatatctgtcatctgctgtgtcttcaatgagttaaaattttaccaaggttttctgtttagtgaaaaaccagaaaagaacttgcttatttttgaaaatctgatcgacctgaagcgccgctataattttcctgtagaagttgaggttcctatggaaagaaagaaaaagtacattgaaattaggaaagaagccagagaagcagcaaatggggattcagatggtccttcctatatgtcttccctgtcatatttggcagacagtaccctgagtgaggaaatgagtcaatttgatttctcaaccggagttcagagctattcatacagctcccaagaccctagacctgccactggtcgttttcggagacgggagcagcgggaccccacggtgcatgatgatgtgctggagctggagatggacgagctcaatcggcatgagtgcatggcgcccctgacggccctggtcaagcacatgcacagaagcctgggcccgcctcaaggagaagaggattcagtgccaagagatcttccttcttggatgaaattcctccatggcaaactgggaaatccaatagtaccattaaatatccgtctcttcttagccaagcttgttattaatacagaagaggtctttcgcccttacgcgaagcactggcttagccccttgctgcagctggctgcttctgaaaacaatggaggagaaggaattcactacatggtggttgagatagtggccactattctttcatggacaggcttggccactccaacaggggtccctaaagatgaagtgttagcaaatcgattgcttaatttcctaatgaaacatgtctttcatccaaaaagagctgtgtttagacacaaccttgaaattataaagacccttgtcgagtgctggaaggattgtttatccatcccttataggttaatatttgaaaagttttccggtaaagatcctaattctaaagacaactcagtagggattcaattgctaggcatcgtgatggccaatgacctgcctccctatgacccacagtgtggcatccagagtagcgaatacttccaggctttggtgaataatatgtcctttgtaagatataaagaagtgtatgccgctgcagcagaagttctaggacttatacttcgatatgttatggagagaaaaaacatactggaggagtctctgtgtgaactggttgcgaaacaattgaagcaacatcagaatactatggaggacaagtttattgtgtgcttgaacaaagtgaccaagagcttccctcctcttgcagacaggttcatgaatgctgtgttctttctgctgccaaaatttcatggagtgttgaaaacactctgtctggaggtggtactttgtcgtgtggagggaatgacagagctgtacttccagttaaagagcaaggacttcgttcaagtcatgagacatagagatgatgaaagacaaaaagtatgtttggacataatttataagatgatgccaaagttaaaaccagtagaactccgagaacttctgaaccccgttgtggaattcgtttcccatccttctacaacatgtagggaacaaatgtataatattctcatgtggattcatgataattacagagatccagaaagtgagacagataatgactcccaggaaatatttaagttggcaaaagatgtgctgattcaaggattgatcgatgagaaccctggacttcaattaattattcgaaatttctggagccatgaaactaggttaccttcaaataccttggaccggttgctggcactaaattccttatattctcctaagatagaagtgcactttttaagtttagcaacaaattttctgctcgaaatgaccagcatgagcccagattatccaaaccccatgttcgagcatcctctgtcagaatgcgaatttcaggaatataccattgattctgattggcgtttccgaagtactgttctcactccgatgtttgtggagacccaggcctcccagggcactctccagacccgtacccaggaagggtccctctcagctcgctggccagtggcagggcagataagggccacccagcagcagcatgacttcacactgacacagactgcagatggaagaagctcatttgattggctgaccgggagcagcactgacccgctggtcgaccacaccagtccctcatctgactccttgctgtttgcccacaagaggagtgaaaggttacagagagcacccttgaagtcagtggggcctgattttgggaaaaaaaggctgggccttccaggggacgaggtggataacaaagtgaaaggtgcggccggccggacggacctactacgactgcgcagacggtttatgagggaccaggagaagctcagtttgatgtatgccagaaaaggcgttgctgagcaaaaacgagagaaggaaatcaagagtgagttaaaaatgaagcaggatgcccaggtcgttctgtacagaagctaccggcacggagaccttcctgacattcagatcaagcacagcagcctcatcaccccgttacaggccgtggcccagagggacccaataattgcaaaacagctctttagcagcttgttttctggaattttgaaagagatggataaatttaagacactgtctgaaaaaaacaacatcactcaaaagttgcttcaagacttcaatcgttttcttaataccaccttctctttctttccaccctttgtctcttgtattcaggacattagctgtcagcacgcagccctgctgagcctcgacccagcggctgttagcgctggttgcctggccagcctacagcagcccgtgggcatccgcctgctagaggaggctctgctccgcctgctgcctgctgagctgcctgccaagcgagtccgtgggaaggcccgcctccctcctgatgtcctcagatgggtggagcttgctaagctgtatagatcaattggagaatacgacgtcctccgtgggatttttaccagtgagataggaacaaagcaaatcactcagagtgcattattagcagaagccagaagtgattattctgaagctgctaagcagtatgatgaggctctcaataaacaagactgggtagatggtgagcccacagaagccgagaaggatttttgggaacttgcatcccttgactgttacaaccaccttgctgagtggaaatcacttgaatactgttctacagccagtatagacagtgagaaccccccagacctaaataaaatctggagtgaaccattttatcaggaaacatatctaccttacatgatccgcagcaagctgaagctgctgctccagggagaggctgaccagtccctgctgacatttattgacaaagctatgcacggggagctccagaaggcgattctagagcttcattacagtcaagagctgagtctgctttacctcctgcaagatgatgttgacagagccaaatattacattcaaaatggcattcagagttttatgcagaattattctagtattgatgtcctcttacaccaaagtagactcaccaaattgcagtctgtacaggctttaacagaaattcaggagttcatcagctttataagcaaacaaggcaatttatcatctcaagttccccttaagagacttctgaacacctggacaaacagatatccagatgctaaaatggacccaatgaacatctgggatgacatcatcacaaatcgatgtttctttctcagcaaaatagaggagaagcttacccctcttccagaagataatagtatgaatgtggatcaagatggagaccccagtgacaggatggaagtgcaagagcaggaagaagatatcagctccctgatcaggagttgcaagttttccatgaaaatgaagatgatagacagtgcccggaagcagaacaatttctcacttgctatgaaactactgaaggagctgcataaagagtcaaaaaccagagacgattggctggtgagctgggtgcagagctactgccgcctgagccactgccggagccggtcccagggctgctctgagcaggtgctcactgtgctgaaaacagtctctttgttggatgagaacaacgtgtcaagctacttaagcaaaaatattctggctttccgtgaccagaacattctcttgggtacaacttacaggatcatagcgaatgctctcagcagtgagccagcctgccttgctgaaatcgaggaggacaaggctagaagaatcttagagctttctggatccagttcagaggattcagagaaggtgatcgcgggtctgtaccagagagcattccagcacctctctgaggctgtgcaggcggctgaggaggaggcccagcctccctcctggagctgtgggcctgcagctggggtgattgatgcttacatgacgctggcagatttctgtgaccaacagctgcgcaaggaggaagagaatgcatcagttattgattctgcagaactgcaggcgtatccagcacttgtggtggagaaaatgttgaaagctttaaaattaaattccaatgaagccagattgaagtttcctagattacttcagattatagaacggtatccagaggagactttgagcctcatgacaaaagagatctcttccgttccctgctggcagttcatcagctggatcagccacatggtggccttactggacaaagaccaagccgttgctgttcagcactctgtggaagaaatcactgataactacccgcaggctattgtttatcccttcatcataagcagcgaaagctattccttcaaggatacttctactggtcataagaataaggagtttgtggcaaggattaaaagtaagttggatcaaggaggagtgattcaagattttattaatgccttagatcagctctctaatcctgaactgctctttaaggattggagcaatgatgtaagagctgaactagcaaaaacccctgtaaataaaaaaaacattgaaaaaatgtatgaaagaatgtatgcagccttgggtgacccaaaggctccaggcctgggggcctttagaaggaagtttattcagacttttggaaaagaatttgataaacattttgggaaaggaggttctaaactactgagaatgaagctcagtgacttcaacgacattaccaacatgctacttttaaaaatgaacaaagactcaaagccccctgggaatctgaaagaatgttcaccctggatgagcgacttcaaagtggagttcctgagaaatgagctggagattcccggtcagtatgacggtaggggaaagccattgccagagtaccacgtgcgaatcgccgggtttgatgagcgggtgacagtcatggcgtctctgcgaaggcccaagcgcatcatcatccgtggccatgacgagagggaacaccctttcctggtgaagggtggcgaggacctgcggcaggaccagcgcgtggagcagctcttccaggtcatgaatgggatcctggcccaagactccgcctgcagccagagggccctgcagctgaggacctatagcgttgtgcccatgacctccaggttaggattaattgagtggcttgaaaatactgttaccttgaaggaccttcttttgaacaccatgtcccaagaggagaaggcggcttacctgagtgatcccagggcaccgccgtgtgaatataaagattggctgacaaaaatgtcaggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggttaaatcaaagataaggttatagtaacatcaaagattaggtgaggtttatagaaagatagatatccaggcttaccaaagtattaagtcaagaatataatatgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaagatacataaaagtgctttgcattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgattggcttttagctttttgttgtttttttttttccttctaacacttgtatttggaggctcttctgtgattttgagaagtatactcttgagtgtttaataaagtttttttccaaaagta

SEQ ID NO: 1057 - DNA, 13142 bp, Homo sapiens
atggcgggctccggagccggtgtgcgttgctccctgctgcggctgcaggagaccttgtccgctgcggaccgctgcggtgctgccctggccggtcatcaactgatccgcggcctggggcaggaatgcgtcctgagcagcagccccgcggtgctggcattacagacatctttagttttttccagagatttcggtttgcttgtatttgtccggaagtcactcaacagtattgaatttcgtgaatgtagagaagaaatcctaaagtttttatgtattttcttagaaaaaatgggccagaagatcgcaccttactctgttgaaattaagaacacttgtaccagtgtttatacaaaagatagagctgctaaatgtaaaattccagccctggaccttcttattaagttacttcagacttttagaagttctagactcatggatgaatttaaaattggagaattatttagtaaattctatggagaacttgcattgaaaaaaaaaataccagatacagttttagaaaaagtatatgagctcctaggattattgggtgaagttcatcctagtgagatgataaataatgcagaaaacctgttccgcgcttttctgggtgaacttaagacccagatgacatcagcagtaagagagcccaaactacctgttctggcaggatgtctgaaggggttgtcctcacttctgtgcaacttcactaagtccatggaagaagatccccagacttcaagggagatttttaattttgtactaaaggcaattcgtcctcagattgatctgaagagatatgctgtgccctcagctggcttgcgcctatttgccctgcatgcatctcagtttagcacctgccttctggacaactacgtgtctctatttgaagtcttgttaaagtggtgtgcccacacaaatgtagaattgaaaaaagctgcactttcagccctggaatcctttctgaaacaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggaccgtgcaaggttataaacgcaaaagatgttgacttcatgtacgttgagctcattcagcgctgcaagcagatgttcctcacccagacagacactggtgacgaccgtgtttatcagatgccaagcttcctccagtctgttgcaagcgtcttgctgtaccttgacacagttcctgaggtgtatactccagttctggagcacctcgtggtgatgcagatagacagtttcccacagtacagtccaaaaatgcagctggtgtgttgcagagccatagtgaaggtgttcctagctttggcagcaaaagggccagttctcaggaattgcattagtactgtggtgcatcagggtttaatcagaatatgttctaaaccagtggtccttccaaagggccctgagtctgaatctgaagaccaccgtgcttcaggggaagtcagaactggcaaatggaaggtgcccacatacaaagactacgtggatctcttcagacatctcctgagctctgaccagatgatggattctattttagcagatgaagcatttttctctgtgaattcctccagtgaaagtctgaatcatttactttatgatgaatttgtaaaatccgttttgaagattgttgagaaattggatcttacacttgaaatacagactgttggggaacaagagaatggagatgaggcgcctggtgtttggatgatcccaacttcagatccagcggctaacttgcatccagctaaacctaaagatttttcggctttcattaacctggtggaattttgcagagagattctccctgagaaacaagcagaattttttgaaccatgggtgtactcattttcatatgaattaattttgcaatctacaaggttgcccctcatcagtggtttctacaaattgctttctattacagtaagaaatgccaagaaaataaaatatttcgagggagttagtccaaagagtctgaaacactctcctgaagacccagaaaagtattcttgctttgctttatttgtgaaatttggcaaagaggtggcagttaaaatgaagcagtacaaagatgaacttttggcctcttgtttgacctttcttctgtccttgccacacaacatcattgaactcgatgttagagcctacgttcctgcactgcagatggctttcaaactgggcctgagctatacccccttggcagaagtaggcctgaatgctctagaagaatggtcaatttatattgacagacatgtaatgcagccttattacaaagacattctcccctgcctggatggatacctgaagacttcagccttgtcagatgagaccaagaataactgggaagtgtcagctctttctcgggctgcccagaaaggatttaataaagtggtgttaaagcatctgaagaagacaaagaacctttcatcaaacgaagcaatatccttagaagaaataagaattagagtagtacaaatgcttggatctctaggaggacaaataaacaaaaatcttctgacagtcacgtcctcagatgagatgatgaagagctatgtggcctgggacagagagaagcggctgagctttgcagtgccctttagagagatgaaacctgtcattttcctggatgtgttcctgcctcgagtcacagaattagcgctcacagccagtgacagacaaactaaagttgcagcctgtgaacttttacatagcatggttatgtttatgttgggcaaagccacgcagatgccagaagggggacagggagccccacccatgtaccagctctataagcggacgtttcctgtgctgcttcgacttgcgtgtgatgttgatcaggtgacaaggcaactgtatgagccactagttatgcagctgattcactggttcactaacaacaagaaatttgaaagtcaggatactgttgccttactagaagctatattggatggaattgtggaccctgttgacagtactttaagagatttttgtggtcggtgtattcgagaattccttaaatggtccattaagcaaataacaccacagcagcaggagaagagtccagtaaacaccaaatcgcttttcaagcgactttatagccttgcgcttcaccccaatgctttcaagaggctgggagcatcacttgcctttaataatatctacagggaattcagggaagaagagtctctggtggaacagtttgtgtttgaagccttggtgatatacatggagagtctggccttagcacatgcagatgagaagtccttaggtacaattcaacagtgttgtgatgccattgatcacctatgccgcatcattgaaaagaagcatgtttctttaaataaagcaaagaaacgacgtttgccgcgaggatttccaccttccgcatcattgtgtttattggatctggtcaagtggcttttagctcattgtgggaggccccagacagaatgtcgacacaaatccattgaactcttttataaattcgttcctttattgccaggcaacagatcccctaatttgtggctgaaagatgttctcaaggaagaaggtgtctcttttctcatcaacacctttgaggggggtggctgtggccagccctcgggcatcctggcccagcccaccctcttgtaccttcgggggccattcagcctgcaggccacgctatgctggctggacctgctcctggccgcgttggagtgctacaacacgttcattggcgagagaactgtaggagcgctccaggtcctaggtactgaagcccagtcttcacttttgaaagcagtggctttcttcttagaaagcattgccatgcatgacattatagcagcagaaaagtgctttggcactggggcagcaggtaacagaacaagcccacaagagggagaaaggtacaactacagcaaatgcaccgttgtggtccggattatggagtttaccacgactctgctaaacacctccccggaaggatggaagctcctgaagaaggacttgtgtaatacacacctgatgagagtcctggtgcagacgctgtgtgagcccgcaagcataggtttcaacatcggagacgtccaggttatggctcatcttcctgatgtttgtgtgaatctgatgaaagctctaaagatgtccccatacaaagatatcctagagacccatctgagagagaaaataacagcacagagcattgaggagctttgtgccgtcaacttgtatggccctgacgcgcaagtggacaggagcaggctggctgctgttgtgtctgcctgtaaacagcttcacagagctgggcttctgcataatatattaccgtctcagtccacagatttgcatcattctgttggcacagaacttctttccctggtttataaaggcattgcccctggagatgagagacagtgtctgccttctctagacctcagttgtaagcagctggccagcggacttctggagttagcctttgcttttggaggactgtgtgagcgccttgtgagtcttctcctgaacccagcggtgctgtccacggcgtccttgggcagctcacagggcagcgtcatccacttctcccatggggagtatttctatagcttgttctcagaaacgatcaacacggaattattgaaaaatctggatcttgctgtattggagctcatgcagtcttcagtggataataccaaaatggtgagtgccgttttgaacggcatgttagaccagagcttcagggagcgagcaaaccagaaacaccaaggactgaaacttgcgactacaattctgcaacactggaagaagtgtgattcatggtgggccaaagattcccctctcgaaactaaaatggcagtgctggccttactggcaaaaattttacagattgattcatctgtatcttttaatacaagtcatggttcattccctgaagtctttacaacatatattagtctacttgctgacacaaagctggatctacatttaaagggccaagctgtcactcttcttccattcttcaccagcctcactggaggcagtctggaggaacttagacgtgttctggagcagctcatcgttgctcacttccccatgcagtccagggaatttcctccaggaactccgcggttcaataattatgtggactgcatgaaaaagtttctagatgcattggaattatctcaaagccctatgttgttggaattgatgacagaagttctttgtcgggaacagcagcatgtcatggaagaattatttcaatccagtttcaggaggattgccagaaggggttcatgtgtcacacaagtaggccttctggaaagcgtgtatgaaatgttcaggaaggatgacccccgcctaagtttcacacgccagtcctttgtggaccgctccctcctcactctgctgtggcactgtagcctggatgctttgagagaattcttcagcacaattgtggtggatgccattgatgtgttgaagtccaggtttacaaagctaaatgaatctacctttgatactcaaatcaccaagaagatgggctactataagattctagacgtgatgtattctcgccttcccaaagatgatgttcatgctaaggaatcaaaaattaatcaagttttccatggctcgtgtattacagaaggaaatgaacttacaaagacattgattaaattgtgctacgatgcatttacagagaacatggcaggagagaatcagctgctggagaggagaagactttaccattgtgcagcatacaactgcgccatatctgtcatctgctgtgtcttcaatgagttaaaattttaccaaggttttctgtttagtgaaaaaccagaaaagaacttgcttatttttgaaaatctgatcgacctgaagcgccgctataattttcctgtagaagttgaggttcctatggaaagaaagaaaaagtacattgaaattaggaaagaagccagagaagcagcaaatggggattcagatggtccttcctatatgtcttccctgtcatatttggcagacagtaccctgagtgaggaaatgagtcaatttgatttctcaaccggagttcagagctattcatacagctcccaagaccctagacctgccactggtcgttttcggagacgggagcagcgggaccccacggtgcatgatgatgtgctggagctggagatggacgagctcaatcggcatgagtgcatggcgcccctgacggccctggtcaagcacatgcacagaagcctgggcccgcctcaaggagaagaggattcagtgccaagagatcttccttcttggatgaaattcctccatggcaaactgggaaatccaatagtaccattaaatatccgtctcttcttagccaagcttgttattaatacagaagaggtctttcgcccttacgcgaagcactggcttagccccttgctgcagctggctgcttctgaaaacaatggaggagaaggaattcactacatggtggttgagatagtggccactattctttcatggacaggcttggccactccaacaggggtccctaaagatgaagtgttagcaaatcgattgcttaatttcctaatgaaacatgtctttcatccaaaaagagctgtgtttagacacaaccttgaaattataaagacccttgtcgagtgctggaaggattgtttatccatcccttataggttaatatttgaaaagttttccggtaaagatcctaattctaaagacaactcagtagggattcaattgctaggcatcgtgatggccaatgacctgcctccctatgacccacagtgtggcatccagagtagcgaatacttccaggctttggtgaataatatgtcctttgtaagatataaagaagtgtatgccgctgcagcagaagttctaggacttatacttcgatatgttatggagagaaaaaacatactggaggagtctctgtgtgaactggttgcgaaacaattgaagcaacatcagaatactatggaggacaagtttattgtgtgcttgaacaaagtgaccaagagcttccctcctcttgcagacaggttcatgaatgctgtgttctttctgctgccaaaatttcatggagtgttgaaaacactctgtctggaggtggtactttgtcgtgtggagggaatgacagagctgtacttccagttaaagagcaaggacttcgttcaagtcatgagacatagagatgatgaaagacaaaaagtatgtttggacataatttataagatgatgccaaagttaaaaccagtagaactccgagaacttctgaaccccgttgtggaattcgtttcccatccttctacaacatgtagggaacaaatgtataatattctcatgtggattcatgataattacagagatccagaaagtgagacagataatgactcccaggaaatatttaagttggcaaaagatgtgctgattcaaggattgatcgatgagaaccctggacttcaattaattattcgaaatttctggagccatgaaactaggttaccttcaaataccttggaccggttgctggcactaaattccttatattctcctaagatagaagtgcactttttaagtttagcaacaaattttctgctcgaaatgaccagcatgagcccagattatccaaaccccatgttcgagcatcctctgtcagaatgcgaatttcaggaatataccattgattctgattggcgtttccgaagtactgttctcactccgatgtttgtggagacccaggcctcccagggcactctccagacccgtacccaggaagggtccctctcagctcgctggccagtggcagggcagataagggccacccagcagcagcatgacttcacactgacacagactgcagatggaagaagctcatttgattggctgaccgggagcagcactgacccgctggtcgaccacaccagtccctcatctgactccttgctgtttgcccacaagaggagtgaaaggttacagagagcacccttgaagtcagtggggcctgattttgggaaaaaaaggctgggccttccaggggacgaggtggataacaaagtgaaaggtgcggccggccggacggacctactacgactgcgcagacggtttatgagggaccaggagaagctcagtttgatgtatgccagaaaaggcgttgctgagcaaaaacgagagaaggaaatcaagagtgagttaaaaatgaagcaggatgcccaggtcgttctgtacagaagctaccggcacggagaccttcctgacattcagatcaagcacagcagcctcatcaccccgttacaggccgtggcccagagggacccaataattgcaaaacagctctttagcagcttgttttctggaattttgaaagagatggataaatttaagacactgtctgaaaaaaacaacatcactcaaaagttgcttcaagacttcaatcgttttcttaataccaccttctctttctttccaccctttgtctcttgtattcaggacattagctgtcagcacgcagccctgctgagcctcgacccagcggctgttagcgctggttgcctggccagcctacagcagcccgtgggcatccgcctgctagaggaggctctgctccgcctgctgcctgctgagctgcctgccaagcgagtccgtgggaaggcccgcctccctcctgatgtcctcagatgggtggagcttgctaagctgtatagatcaattggagaatacgacgtcctccgtgggatttttaccagtgagataggaacaaagcaaatcactcagagtgcattattagcagaagccagaagtgattattctgaagctgctaagcagtatgatgaggctctcaataaacaagactgggtagatggtgagcccacagaagccgagaaggatttttgggaacttgcatcccttgactgttacaaccaccttgctgagtggaaatcacttgaatactgttctacagccagtatagacagtgagaaccccccagacctaaataaaatctggagtgaaccattttatcaggaaacatatctaccttacatgatccgcagcaagctgaagctgctgctccagggagaggctgaccagtccctgctgacatttattgacaaagctatgcacggggagctccagaaggcgattctagagcttcattacagtcaagagctgagtctgctttacctcctgcaagatgatgttgacagagccaaatattacattcaaaatggcattcagagttttatgcagaattattctagtattgatgtcctcttacaccaaagtagactcaccaaattgcagtctgtacaggctttaacagaaattcaggagttcatcagctttataagcaaacaaggcaatttatcatctcaagttccccttaagagacttctgaacacctggacaaacagatatccagatgctaaaatggacccaatgaacatctgggatgacatcatcacaaatcgatgtttctttctcagcaaaatagaggagaagcttacccctcttccagaagataatagtatgaatgtggatcaagatggagaccccagtgacaggatggaagtgcaagagcaggaagaagatatcagctccctgatcaggagttgcaagttttccatgaaaatgaagatgatagacagtgcccggaagcagaacaatttctcacttgctatgaaactactgaaggagctgcataaagagtcaaaaaccagagacgattggctggtgagctgggtgcagagctactgccgcctgagccactgccggagccggtcccagggctgctctgagcaggtgctcactgtgctgaaaacagtctctttgttggatgagaacaacgtgtcaagctacttaagcaaaaatattctggctttccgtgaccagaacattctcttgggtacaacttacaggatcatagcgaatgctctcagcagtgagccagcctgccttgctgaaatcgaggaggacaaggctagaagaatcttagagctttctggatccagttcagaggattcagagaaggtgatcgcgggtctgtaccagagagcattccagcacctctctgaggctgtgcaggcggctgaggaggaggcccagcctccctcctggagctgtgggcctgcagctggggtgattgatgcttacatgacgctggcagatttctgtgaccaacagctgcgcaaggaggaagagaatgcatcagttattgattctgcagaactgcaggcgtatccagcacttgtggtggagaaaatgttgaaagctttaaaattaaattccaatgaagccagattgaagtttcctagattacttcagattatagaacggtatccagaggagactttgagcctcatgacaaaagagatctcttccgttccctgctggcagttcatcagctggatcagccacatggtggccttactggacaaagaccaagccgttgctgttcagcactctgtggaagaaatcactgataactacccgcaggctattgtttatcccttcatcataagcagcgaaagctattccttcaaggatacttctactggtcataagaataaggagtttgtggcaaggattaaaagtaagttggatcaaggaggagtgattcaagattttattaatgccttagatcagctctctaatcctgaactgctctttaaggattggagcaatgatgtaagagctgaactagcaaaaacccctgtaaataaaaaaaacattgaaaaaatgtatgaaagaatgtatgcagccttgggtgacccaaaggctccaggcctgggggcctttagaaggaagtttattcagacttttggaaaagaatttgataaacattttgggaaaggaggttctaaactactgagaatgaagctcagtgacttcaacgacattaccaacatgctacttttaaaaatgaacaaagactcaaagccccctgggaatctgaaagaatgttcaccctggatgagcgacttcaaagtggagttcctgagaaatgagctggagattcccggtcagtatgacggtaggggaaagccattgccagagtaccacgtgcgaatcgccgggtttgatgagcgggtagtcatggcgtctctgcgaaggcccaagcgcatcatcatccgtggccatgacgagagggaacaccctttcctggtgaagggtggcgaggacctgcggcaggaccagcgcgtggagcagctcttccaggtcatgaatgggatcctggcccaagactccgcctgcagccagagggccctgcagctgaggacctatagcgttgtgcccatgacctccagtgatcccagggcaccgccgtgtgaatataaagattggctgacaaaaatgtcaggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggtttgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaagatacataaaagtgctttgcattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgat

SEQ ID NO: 1058 - DNA, 12603 bp, Homo sapiens
gcggcatggcgggctccggagccggtgtgcgttgctccctgctgcggctgcaggagaccttgtccgctgcggaccgctgcggtgctgccctggccggtcatcaactgatccgcggcctggggcaggaatgcgtcctgagcagcagccccgcggtgctggcattacagacatctttagttttttccagagatttcggtttgcttgtatttgtccggaagtcactcaacagtattgaatttcgtgaatgtagagaagaaatcctaaagtttttatgtattttcttagaaaaaatgggccagaagatcgcaccttactctgttgaaattaagaacacttgtaccagtgtttatacaaaagatagagctgctaaatgtaaaattccagccctggaccttcttattaagttacttcagacttttagaagttctagactcatggatgaatttaaaattggagaattatttagtaaattctatggagaacttgcattgaaaaaaaaaataccagatacagttttagaaaaagtatatgagctcctaggattattgggtgaagttcatcctagtgagatgataaataatgcagaaaacctgttccgcgcttttctgggtgaacttaagacccagatgacatcagcagtaagagagcccaaactacctgttctggcaggatgtctgaaggggttgtcctcacttctgtgcaacttcactaagtccatggaagaagatccccagacttcaagggagatttttaattttgtactaaaggcaattcgtcctcagattgatctgaagagatatgctgtgccctcagctggcttgcgcctatttgccctgcatgcatctcagtttagcacctgccttctggacaactacgtgtctctatttgaagtcttgttaaagtggtgtgcccacacaaatgtagaattgaaaaaagctgcactttcagccctggaatcctttctgaaacaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggaccgtgcaaggttataaacgcaaaagatgttgacttcatgtacgttgagctcattcagcgctgcaagcagatgttcctcacccagacagacactggtgactaccgtgtttatcagatgccaagcttcctccagtctgttgcaagcgtcttgctgtaccttgacacagttcctgaggtgtatactccagttctggagcacctcgtggtgatgcagatagacagtttcccacagtacagtccaaaaatgcagctggtgtgttgcagagccatagtgaaggtgttcctagctttggcagcaaaagggccagttctcaggaattgcattagtactgtggtgcatcagggtttaatcagaatatgttctaaaccagtggtccttccaaagggccctgagtctgaatctgaagaccaccgtgcttcaggggaagtcagaactggcaaatggaaggtgcccacatacaaagactacgtggatctcttcagacatctcctgagctctgaccagatgatggattctattttagcagatgaagcatttttctctgtgaattcctccagtgaaagtctgaatcatttactttatgatgaatttgtaaaatccgttttgaagattgttgagaaattggatcttacacttgaaatacagactgttggggaacaagagaatggagatgaggcgcctggtgtttggatgatcccaacttcagatccagcggctaacttgcatccagctaaacctaaagatttttcggctttcattaacctggtggaattttgcagagagattctccctgagaaacaagcagaattttttgaaccatgggtgtactcattttcatatgaattaattttgcaatctacaaggttgcccctcatcagtggtttctacaaattgctttctattacagtaagaaatgccaagaaaataaaatatttcgagggagttagtccaaagagtctgaaacactctcctgaagacccagaaaagtattcttgctttgctttatttgtgaaatttggcaaagaggtggcagttaaaatgaagcagtacaaagatgaacttttggcctcttgtttgacctttcttctgtccttgccacacaacatcattgaactcgatgttagagcctacgttcctgcactgcagatggctttcaaactgggcctgagctatacccccttggcagaagtaggcctgaatgctctagaagaatggtcaatttatattgacagacatgtaatgcagccttattacaaagacattctcccctgcctggatggatacctgaagacttcagccttgtcagatgagaccaagaataactgggaagtgtcagctctttctcgggctgcccagaaaggatttaataaagtggtgttaaagcatctgaagaagacaaagaacctttcatcaaacgaagcaatatccttagaagaaataagaattagagtagtacaaatgcttggatctctaggaggacaaataaacaaaaatcttctgacagtcacgtcctcagatgagatgatgaagagctatgtggcctgggacagagagaagcggctgagctttgcagtgccctttagagagatgaaacctgtcattttcctggatgtgttcctgcctcgagtcacagaattagcgctcacagccagtgacagacaaactaaagttgcagcctgtgaacttttacatagcatggttatgtttatgttgggcaaagccacgcagatgccagaagggggacagggagccccacccatgtaccagctctataagcggacgtttcctgtgctgcttcgacttgcgtgtgatgttgatcaggtgacaaggcaactgtatgagccactagttatgcagctgattcactggttcactaacaacaagaaatttgaaagtcaggatactgtttccttactagaagctatattggatggaattgtggaccctgttgacagtactttaagagatttttgtggtcggtgtattcgagaattccttaaatggtccattaagcaaataacaccacagcagcaggagaagagtccagtaaacaccaaatcgcttttcaagcgactttatagccttgcgcttcaccccaatgctttcaagaggctgggagcatcacttgcctttaataatatctacagggaattcagggaagaagagtctctggtggaacagtttgtgtttgaagccttggtgatatacatggagagtctggccttagcacatgcagatgagaagtccttaggtacaattcaacagtgttgtgatgccattgatcacctatgccgcatcattgaaaagaagcatgtttctttaaataaagcaaagaaacgacgtttgccgcgaggatttccaccttccgcatcattgtgtttattggatctggtcaagtggcttttagctcattgtgggaggccccagacagaatgtcgacacaaatccattgaactcttttataaattcgttcctttattgccaggcaacagatcccctaatttgtggctgaaagatgttctcaaggaagaaggtgtctcttttctcatcaacacctttgaggggggtggctgtggccagccctcgggcatcctggcccagcccaccctcttgtaccttcgggggccattcagcctgcaggccacgctatgctggctggacctgctcctggccgcgttggagtgctacaacacgttcattggcgagagaactgtaggagcgctccaggtcctaggtactgaagcccagtcttcacttttgaaagcagtggctttcttcttagaaagcattgccatgcatgacattatagcagcagaaaagtgctttggcactggggcagcaggtaacagaacaagcccacaagagggagaaaggtacaactacagcaaatgcaccgttgtggtccggattatggagtttaccacgactctgctaaacacctccccggaaggatggaagctcctgaagaaggacttgtgtaatacacacctgatgagagtcctggtgcagacgctgtgtgagcccgcaagcataggtttcaacatcggagacgtccaggttatggctcatcttcctgatgtttgtgtgaatctgatgaaagctctaaagatgtccccatacaaagatatcctagagacccatctgagagagaaaataacagcacagagcattgaggagctttgtgccgtcaacttgtatggccctgacgcgcaagtggacaggagcaggctggctgctgttgtgtctgcctgtaaacagcttcacagagctgggcttctgcataatatattaccgtctcagtccacagatttgcatcattctgttggcacagaacttctttccctggtttataaaggcattgcccctggagatgagagacagtgtctgccttctctagacctcagttgtaagcagctggccagcggacttctggagttagcctttgcttttggaggactgtgtgagcgccttgtgagtcttctcctgaacccagcggtgctgtccacggcgtccttgggcagctcacagggcagcgtcatccacttctcccatggggagtatttctatagcttgttctcagaaacgatcaacacggaattattgaaaaatctggatcttgctgtattggagctcatgcagtcttcagtggataataccaaaatggtgagtgccgttttgaacggcatgttagaccagagcttcagggagcgagcaaaccagaaacaccaaggactgaaacttgcgactacaattctgcaacactggaagaagtgtgattcatggtgggccaaagattcccctctcgaaactaaaatggcagtgctggccttactggcaaaaattttacagattgattcatctgtatcttttaatacaagtcatggttcattccctgaagtctttacaacatatattagtctacttgctgacacaaagctggatctacatttaaagggccaagctgtcactcttcttccattcttcaccagcctcactggaggcagtctggaggaacttagacgtgttctggagcagctcatcgttgctcacttccccatgcagtccagggaatttcctccaggaactccgcggttcaataattatgtggactgcatgaaaaagtttctagatgcattggaattatctcaaagccctatgttgttggaattgatgacagaagttctttgtcgggaacagcagcatgtcatggaagaattatttcaatccagtttcaggaggattgccagaaggggttcatgtgtcacacaagtaggccttctggaaagcgtgtatgaaatgttcaggaaggatgacccccgcctaagtttcacacgccagtcctttgtggaccgctccctcctcactctgctgtggcactgtagcctggatgctttgagagaattcttcagcacaattgtggtggatgccattgatgtgttgaagtccaggtttacaaagctaaatgaatctacctttgatactcaaatcaccaagaagatgggctactataagattctagacgtgatgtattctcgccttcccaaagatgatgttcatgctaaggaatcaaaaattaatcaagttttccatggctcgtgtattacagaaggaaatgaacttacaaagacattgattaaattgtgctacgatgcatttacagagaacatggcaggagagaatcagctgctggagaggagaagactttaccattgtgcagcatacaactgcgccatatctgtcatctgctgtgtcttcaatgagttaaaattttaccaaggttttctgtttagtgaaaaaccagaaaagaacttgcttatttttgaaaatctgatcgacctgaagcgccgctataattttcctgtagaagttgaggttcctatggaaagaaagaaaaagtacattgaaattaggaaagaagccagagaagcagcaaatggggattcagatggtccttcctatatgtcttccctgtcatatttggcagacagtaccctgagtgaggaaatgagtcaatttgatttctcaaccggagttcagagctattcatacagctcccaagaccctagacctgccactggtcgttttcggagacgggagcagcgggaccccacggtgcatgatgatgtgctggagctggagatggacgagctcaatcggcatgagtgcatggcgcccctgacggccctggtcaagcacatgcacagaagcctgggcccgcctcaaggagaagaggattcagtgccaagagatcttccttcttggatgaaattcctccatggcaaactgggaaatccaatagtaccattaaatatccgtctcttcttagccaagcttgttattaatacagaagaggtctttcgcccttacgcgaagcactggcttagccccttgctgcagctggctgcttctgaaaacaatggaggagaaggaattcactacatggtggttgagatagtggccactattctttcatggacaggcttggccactccaacaggggtccctaaagatgaagtgttagcaaatcgattgcttaatttcctaatgaaacatgtctttcatccaaaaagagctgtgtttagacacaaccttgaaattataaagacccttgtcgagtgctggaaggattgtttatccatcccttataggttaatatttgaaaagttttccggtaaagatcctaattctaaagacaactcagtagggattcaattgctaggcatcgtgatggccaatgacctgcctccctatgacccacagtgtggcatccagagtagcgaatacttccaggctttggtgaataatatgtcctttgtaagatataaagaagtgtatgccgctgcagcagaagttctaggacttatacttcgatatgttatggagagaaaaaacatactggaggagtctctgtgtgaactggttgcgaaacaattgaagcaacatcagaatactatggaggacaagtttattgtgtgcttgaacaaagtgaccaagagcttccctcctcttgcagacaggttcatgaatgctgtgttctttctgctgccaaaatttcatggagtgttgaaaacactctgtctggaggtggtactttgtcgtgtggagggaatgacagagctgtacttccagttaaagagcaaggacttcgttcaagtcatgagacatagagatgaaagacaaaaagtatgtttggacataatttataagatgatgccaaagttaaaaccagtagaactccgagaacttctgaaccccgttgtggaattcgtttcccatccttctacaacatgtagggaacaaatgtataatattctcatgtggattcatgataattacagagatccagaaagtgagacagataatgactcccaggaaatatttaagttggcaaaagatgtgctgattcaaggattgatcgatgagaaccctggacttcaattaattattcgaaatttctggagccatgaaactaggttaccttcaaataccttggaccggttgctggcactaaattccttatattctcctaagatagaagtgcactttttaagtttagcaacaaattttctgctcgaaatgaccagcatgagcccagattatccaaaccccatgttcgagcatcctctgtcagaatgcgaatttcaggaatataccattgattctgattggcgtttccgaagtactgttctcactccgatgtttgtggagacccaggcctcccagggcactctccagacccgtacccaggaagggtccctctcagctcgctggccagtggcagggcagataagggccacccagcagcagcatgacttcacactgacacagactgcagatggaagaagctcatttgattggctgaccgggagcagcactgacccgctggtcgaccacaccagtccctcatctgactccttgctgtttgcccacaagaggagtgaaaggttacagagagcacccttgaagtcagtggggcctgattttgggaaaaaaaggctgggccttccaggggacgaggtggataacaaagtgaaaggtgcggccggccggacggacctactacgactgcgcagacggtttatgagggaccaggagaagctcagtttgatgtatgccagaaaaggcgttgctgagcaaaaacgagagaaggaaatcaagagtgagttaaaaatgaagcaggatgcccaggtcgttctgtacagaagctaccggcacggagaccttcctgacattcagatcaagcacagcagcctcatcaccccgttacaggccgtggcccagagggacccaataattgcaaaacagctctttagcagcttgttttctggaattttgaaagagatggataaatttaagacactgtctgaaaaaaacaacatcactcaaaagttgcttcaagacttcaatcgttttcttaataccaccttctctttctttccaccctttgtctcttgtattcaggacattagctgtcagcacgcagccctgctgagcctcgacccagcggctgttagcgctggttgcctggccagcctacagcagcccgtgggcatccgcctgctagaggaggctctgctccgcctgctgcctgctgagctgcctgccaagcgagtccgtgggaaggcccgcctccctcctgatgtcctcagatgggtggagcttgctaagctgtatagatcaattggagaatacgacgtcctccgtgggatttttaccagtgagataggaacaaagcaaatcactcagagtgcattattagcagaagccagaagtgattattctgaagctgctaagcagtatgatgaggctctcaataaacaagactgggtagatggtgagcccacagaagccgagaaggatttttgggaacttgcatcccttgactgttacaaccaccttgctgagtggaaatcacttgaatactgttctacagccagtatagacagtgagaaccccccagacctaaataaaatctggagtgaaccattttatcaggaaacatatctaccttacatgatccgcagcaagctgaagctgctgctccagggagaggctgaccagtccctgctgacatttattgacaaagctatgcacggggagctccagaaggcgattctagagcttcattacagtcaagagctgagtctgctttacctcctgcaagatgatgttgacagagccaaatattacattcaaaatggcattcagagttttatgcagaattattctagtattgatgtcctcttacaccaaagtagactcaccaaattgcagtctgtacaggctttaacagaaattcaggagttcatcagctttataagcaaacaaggcaatttatcatctcaagttccccttaagagacttctgaacacctggacaaacagatatccagatgctaaaatggacccaatgaacatctgggatgacatcatcacaaatcgatgtttctttctcagcaaaatagaggagaagcttacccctcttccagaagataatagtatgaatgtggatcaagatggagaccccagtgacaggatggaagtgcaagagcaggaagaagatatcagctccctgatcaggagttgcaagttttccatgaaaatgaagatgatagacagtgcccggaagcagaacaatttctcacttgctatgaaactactgaaggagctgcataaagagtcaaaaaccagagacgattggctggtgagctgggtgcagagctactgccgcctgagccactgccggagccggtcccagggctgctctgagcaggtgctcactgtgctgaaaacagtctctttgttggatgagaacaacgtgtcaagctacttaaacaaaaatattctggctttccgtgaccagaacattctcttgggtacaacttacaggatcatagcgaatgctctcagcagtgagccagcctgccttgctgaaatcgaggaggacaaggctagaagaatcttagagctttctggatccagttcagaggattcagagaaggtgatcgcgggtctgtaccagagagcattccagcacctctctgaggctgtgcaggcggctgaggaggaggcccagcctccctcctggagctgtgggcctgcagctggggtgattgatgcttacatgacgctggcagatttctgtgaccaacagctgcgcaaggaggaagagaatgcatcagttactgattctgcagaactgcaggcgtatccagcacttgtggtggagaaaatgttgaaagctttaaaattaaattccaatgaagccagattgaagtttcctagattacttcagattatagaacggtatccagaggagactttgagcctcatgacaaaagagatctcttccgttccctgctggcagttcatcagctggatcagccacatggtggccttactggacaaagaccaagccgttgctgttcagcactctgtggaagaaatcactgataactacccgcaggctattgtttatcccttcatcataagcagcgaaagctattccttcaaggatacttctactggtcataagaataaggagtttgtggcaaggattaaaagtaagttggatcaaggaggagtgattcaagattttattaatgccttagatcagctctctaatcctgaactgctctttaaggattggagcaatgatgtaagagctgaactagcaaaaacccctgtaaataaaaaaaacattgaaaaaatgtatgaaagaatgtatgcagccttgggtgacccaaaggctccaggcctgggggcctttagaaggaagtttattcagacttttggaaaagaatttgataaacattttgggaaaggaggttctaaactactgagaatgaagctcagtgacttcaacgacattaccaacatgctacttttaaaaatgaacaaagactcaaagccccctgggaatctgaaagaatgttcaccctggatgagcgacttcaaagtggagttcctgagaaatgagctggagattcccggtcagtatgacggtaggggaaagccattgccagagtaccacgtgcgaatcgccgggtttgatgagcgggtgacagtcatggcgtctctgcgaaggcccaagcgcatcatcatccgtggccatgacgagagggaacaccctttcctggtgaagggtggcgaggacctgcggcaggaccagcgcgtggagcagctcttccaggtcatgaatgggatcctggcccaagactccgcctgcagccagagggccctgcagctgaggacctatagcgttgtgcccatgacctccagtgatcccagggcaccgccgtgtgaatataaagattggctgacaaaaatgtcaggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatacttggttggcagcattccatgagctgattttcctgaaacactaaagagaaatgtcttttgtgctacagtttcgtagcatgagtttaaatcaagattatgatgagtaaatgtgtatgggttaaatcaaagataaggttatagtaacatcaaagattaggtgaggtttatagaaagatagatatccaggcttaccaaagtattaagtcaagaatataatatgtgatcagctttcaaagcatttacaagtgctgc

SEQ ID NO: 1059 - DNA, 13449 bp, Homo sapiens
atggcgggctccggagccggtgtgcgttgctccctgctgcggctgcaggagaccttgtccgctgcggaccgctgcggtgctgccctggccggtcatcaactgatccgcggcctggggcaggaatgcgtcctgagcagcagccccgcggtgctggcattacagacatctttagttttttccagagatttcggtttgcttgtatttgtccggaagtcactcaacagtattgaatttcgtgaatgtagagaagaaatcctaaagtttttatgtattttcttagaaaaaatgggccagaagatcgcaccttactctgttgaaattaagaacacttgtaccagtgtttatacaaaagatagagctgctaaatgtaaaattccagccctggaccttcttattaagttacttcagacttttagaagttctagactcatggatgaatttaaaattggagaattatttagtaaattctatggagaacttgcattgaaaaaaaaaataccagatacagttttagaaaaagtatatgagctcctaggattattgggtgaagttcatcctagtgagatgataaataatgcagaaaacctgttccgcgcttttctgggtgaacttaagacccagatgacatcagcagtaagagagcccaaactacctgttctggcaggatgtctgaaggggttgtcctcacttctgtgcaacttcactaagtccatggaagaagatccccagacttcaagggagatttttaattttgtactaaaggcaattcgtcctcagattgatctgaagagatatgctgtgccctcagctggcttgcgcctatttgccctgcatgcatctcagtttagcacctgccttctggacaactacgtgtctctatttgaagtcttgttaaagtggtgtgcccacacaaatgtagaattgaaaaaagctgcactttcagccctggaatcctttctgaaacaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggaccgtgcaaggttataaacgcaaaagatgttgacttcatgtacgttgagctcattcagcgctgcaagcagatgttcctcacccagacagacactggtgacgaccgtgtttatcagatgccaagcttcctccagtctgttgcaagcgtcttgctgtaccttgacacagttcctgaggtgtatactccagttctggagcacctcgtggtgatgcagatagacagtttcccacagtacagtccaaaaatgcagctggtgtgttgcagagccatagtgaaggtgttcctagctttggcagcaaaagggccagttctcaggaattgcattagtactgtggtgcatcagggtttaatcagaatatgttctaaaccagtggtccttccaaagggccctgagtctgaatctgaagaccaccgtgcttcaggggaagtcagaactggcaaatggaaggtgcccacatacaaagactacgtggatctcttcagacatctcctgagctctgaccagatgatggattctattttagcagatgaagcatttttctctgtgaattcctccagtgaaagtctgaatcatttactttatgatgaatttgtaaaatccgttttgaagattgttgagaaattggatcttacacttgaaatacagactgttggggaacaagagaatggagatgaggcgcctggtgtttggatgatcccaacttcagatccagcggctaacttgcatccagctaaacctaaagatttttcggctttcattaacctggtggaattttgcagagagattctccctgagaaacaagcagaattttttgaaccatgggtgtactcattttcatatgaattaattttgcaatctacaaggttgcccctcatcagtggtttctacaaattgctttctattacagtaagaaatgccaagaaaataaaatatttcgagggagttagtccaaagagtctgaaacactctcctgaagacccagaaaagtattcttgctttgctttatttgtgaaatttggcaaagaggtggcagttaaaatgaagcagtacaaagatgaacttttggcctcttgtttgacctttcttctgtccttgccacacaacatcattgaactcgatgttagagcctacgttcctgcactgcagatggctttcaaactgggcctgagctatacccccttggcagaagtaggcctgaatgctctagaagaatggtcaatttatattgacagacatgtaatgcagccttattacaaagacattctcccctgcctggatggatacctgaagacttcagccttgtcagatgagaccaagaataactgggaagtgtcagctctttctcgggctgcccagaaaggatttaataaagtggtgttaaagcatctgaagaagacaaagaacctttcatcaaacgaagcaatatccttagaagaaataagaattagagtagtacaaatgcttggatctctaggaggacaaataaacaaaaatcttctgacagtcacgtcctcagatgagatgatgaagagctatgtggcctgggacagagagaagcggctgagctttgcagtgccctttagagagatgaaacctgtcattttcctggatgtgttcctgcctcgagtcacagaattagcgctcacagccagtgacagacaaactaaagttgcagcctgtgaacttttacatagcatggttatgtttatgttgggcaaagccacgcagatgccagaagggggacagggagccccacccatgtaccagctctataagcggacgtttcctgtgctgcttcgacttgcgtgtgatgttgatcaggtgacaaggcaactgtatgagccactagttatgcagctgattcactggttcactaacaacaagaaatttgaaagtcaggatactgttgccttactagaagctatattggatggaattgtggaccctgttgacagtactttaagagatttttgtggtcggtgtattcgagaattccttaaatggtccattaagcaaataacaccacagcagcaggagaagagtccagtaaacaccaaatcgcttttcaagcgactttatagccttgcgcttcaccccaatgctttcaagaggctgggagcatcacttgcctttaataatatctacagggaattcagggaagaagagtctctggtggaacagtttgtgtttgaagccttggtgatatacatggagagtctggccttagcacatgcagatgagaagtccttaggtacaattcaacagtgttgtgatgccattgatcacctatgccgcatcattgaaaagaagcatgtttctttaaataaagcaaagaaacgacgtttgccgcgaggatttccaccttccgcatcattgtgtttattggatctggtcaagtggcttttagctcattgtgggaggccccagacagaatgtcgacacaaatccattgaactcttttataaattcgttcctttattgccaggcaacagatcccctaatttgtggctgaaagatgttctcaaggaagaaggtgtctcttttctcatcaacacctttgaggggggtggctgtggccagccctcgggcatcctggcccagcccaccctcttgtaccttcgggggccattcagcctgcaggccacgctatgctggctggacctgctcctggccgcgttggagtgctacaacacgttcattggcgagagaactgtaggagcgctccaggtcctaggtactgaagcccagtcttcacttttgaaagcagtggctttcttcttagaaagcattgccatgcatgacattatagcagcagaaaagtgctttggcactggggcagcaggtaacagaacaagcccacaagagggagaaaggtacaactacagcaaatgcaccgttgtggtccggattatggagtttaccacgactctgctaaacacctccccggaaggatggaagctcctgaagaaggacttgtgtaatacacacctgatgagagtcctggtgcagacgctgtgtgagcccgcaagcataggtttcaacatcggagacgtccaggttatggctcatcttcctgatgtttgtgtgaatctgatgaaagctctaaagatgtccccatacaaagatatcctagagacccatctgagagagaaaataacagcacagagcattgaggagctttgtgccgtcaacttgtatggccctgacgcgcaagtggacaggagcaggctggctgctgttgtgtctgcctgtaaacagcttcacagagctgggcttctgcataatatattaccgtctcagtccacagatttgcatcattctgttggcacagaacttctttccctggtttataaaggcattgcccctggagatgagagacagtgtctgccttctctagacctcagttgtaagcagctggccagcggacttctggagttagcctttgcttttggaggactgtgtgagcgccttgtgagtcttctcctgaacccagcggtgctgtccacggcgtccttgggcagctcacagggcagcgtcatccacttctcccatggggagtatttctatagcttgttctcagaaacgatcaacacggaattattgaaaaatctggatcttgctgtattggagctcatgcagtcttcagtggataataccaaaatggtgagtgccgttttgaacggcatgttagaccagagcttcagggagcgagcaaaccagaaacaccaaggactgaaacttgcgactacaattctgcaacactggaagaagtgtgattcatggtgggccaaagattcccctctcgaaactaaaatggcagtgctggccttactggcaaaaattttacagattgattcatctgtatcttttaatacaagtcatggttcattccctgaagtctttacaacatatattagtctacttgctgacacaaagctggatctacatttaaagggccaagctgtcactcttcttccattcttcaccagcctcactggaggcagtctggaggaacttagacgtgttctggagcagctcatcgttgctcacttccccatgcagtccagggaatttcctccaggaactccgcggttcaataattatgtggactgcatgaaaaagtttctagatgcattggaattatctcaaagccctatgttgttggaattgatgacagaagttctttgtcgggaacagcagcatgtcatggaagaattatttcaatccagtttcaggaggattgccagaaggggttcatgtgtcacacaagtaggccttctggaaagcgtgtatgaaatgttcaggaaggatgacccccgcctaagtttcacacgccagtcctttgtggaccgctccctcctcactctgctgtggcactgtagcctggatgctttgagagaattcttcagcacaattgtggtggatgccattgatgtgttgaagtccaggtttacaaagctaaatgaatctacctttgatactcaaatcaccaagaagatgggctactataagattctagacgtgatgtattctcgccttcccaaagatgatgttcatgctaaggaatcaaaaattaatcaagttttccatggctcgtgtattacagaaggaaatgaacttacaaagacattgattaaattgtgctacgatgcatttacagagaacatggcaggagagaatcagctgctggagaggagaagactttaccattgtgcagcatacaactgcgccatatctgtcatctgctgtgtcttcaatgagttaaaattttaccaaggttttctgtttagtgaaaaaccagaaaagaacttgcttatttttgaaaatctgatcgacctgaagcgccgctataattttcctgtagaagttgaggttcctatggaaagaaagaaaaagtacattgaaattaggaaagaagccagagaagcagcaaatggggattcagatggtccttcctatatgtcttccctgtcatatttggcagacagtaccctgagtgaggaaatgagtcaatttgatttctcaaccggagttcagagctattcatacagctcccaagaccctagacctgccactggtcgttttcggagacgggagcagcgggaccccacggtgcatgatgatgtgctggagctggagatggacgagctcaatcggcatgagtgcatggcgcccctgacggccctggtcaagcacatgcacagaagcctgggcccgcctcaaggagaagaggattcagtgccaagagatcttccttcttggatgaaattcctccatggcaaactgggaaatccaatagtaccattaaatatccgtctcttcttagccaagcttgttattaatacagaagaggtctttcgcccttacgcgaagcactggcttagccccttgctgcagctggctgcttctgaaaacaatggaggagaaggaattcactacatggtggttgagatagtggccactattctttcatggacaggcttggccactccaacaggggtccctaaagatgaagtgttagcaaatcgattgcttaatttcctaatgaaacatgtctttcatccaaaaagagctgtgtttagacacaaccttgaaattataaagacccttgtcgagtgctggaaggattgtttatccatcccttataggttaatatttgaaaagttttccggtaaagatcctaattctaaagacaactcagtagggattcaattgctaggcatcgtgatggccaatgacctgcctccctatgacccacagtgtggcatccagagtagcgaatacttccaggctttggtgaataatatgtcctttgtaagatataaagaagtgtatgccgctgcagcagaagttctaggacttatacttcgatatgttatggagagaaaaaacatactggaggagtctctgtgtgaactggttgcgaaacaattgaagcaacatcagaatactatggaggacaagtttattgtgtgcttgaacaaagtgaccaagagcttccctcctcttgcagacaggttcatgaatgctgtgttctttctgctgccaaaatttcatggagtgttgaaaacactctgtctggaggtggtactttgtcgtgtggagggaatgacagagctgtacttccagttaaagagcaaggacttcgttcaagtcatgagacatagagatgatgaaagacaaaaagtatgtttggacataatttataagatgatgccaaagttaaaaccagtagaactccgagaacttctgaaccccgttgtggaattcgtttcccatccttctacaacatgtagggaacaaatgtataatattctcatgtggattcatgataattacagagatccagaaagtgagacagataatgactcccaggaaatatttaagttggcaaaagatgtgctgattcaaggattgatcgatgagaaccctggacttcaattaattattcgaaatttctggagccatgaaactaggttaccttcaaataccttggaccggttgctggcactaaattccttatattctcctaagatagaagtgcactttttaagtttagcaacaaattttctgctcgaaatgaccagcatgagcccagattatccaaaccccatgttcgagcatcctctgtcagaatgcgaatttcaggaatataccattgattctgattggcgtttccgaagtactgttctcactccgatgtttgtggagacccaggcctcccagggcactctccagacccgtacccaggaagggtccctctcagctcgctggccagtggcagggcagataagggccacccagcagcagcatgacttcacactgacacagactgcagatggaagaagctcatttgattggctgaccgggagcagcactgacccgctggtcgaccacaccagtccctcatctgactccttgctgtttgcccacaagaggagtgaaaggttacagagagcacccttgaagtcagtggggcctgattttgggaaaaaaaggctgggccttccaggggacgaggtggataacaaagtgaaaggtgcggccggccggacggacctactacgactgcgcagacggtttatgagggaccaggagaagctcagtttgatgtatgccagaaaaggcgttgctgagcaaaaacgagagaaggaaatcaagagtgagttaaaaatgaagcaggatgcccaggtcgttctgtacagaagctaccggcacggagaccttcctgacattcagatcaagcacagcagcctcatcaccccgttacaggccgtggcccagagggacccaataattgcaaaacagctctttagcagcttgttttctggaattttgaaagagatggataaatttaagacactgtctgaaaaaaacaacatcactcaaaagttgcttcaagacttcaatcgttttcttaataccaccttctctttctttccaccctttgtctcttgtattcaggacattagctgtcagcacgcagccctgctgagcctcgacccagcggctgttagcgctggttgcctggccagcctacagcagcccgtgggcatccgcctgctagaggaggctctgctccgcctgctgcctgctgagctgcctgccaagcgagtccgtgggaaggcccgcctccctcctgatgtcctcagatgggtggagcttgctaagctgtatagatcaattggagaatacgacgtcctccgtgggatttttaccagtgagataggaacaaagcaaatcactcagagtgcattattagcagaagccagaagtgattattctgaagctgctaagcagtatgatgaggctctcaataaacaagactgggtagatggtgagcccacagaagccgagaaggatttttgggaacttgcatcccttgactgttacaaccaccttgctgagtggaaatcacttgaatactgttctacagccagtatagacagtgagaaccccccagacctaaataaaatctggagtgaaccattttatcaggaaacatatctaccttacatgatccgcagcaagctgaagctgctgctccagggagaggctgaccagtccctgctgacatttattgacaaagctatgcacggggagctccagaaggcgattctagagcttcattacagtcaagagctgagtctgctttacctcctgcaagatgatgttgacagagccaaatattacattcaaaatggcattcagagttttatgcagaattattctagtattgatgtcctcttacaccaaagtagactcaccaaattgcagtctgtacaggctttaacagaaattcaggagttcatcagctttataagcaaacaaggcaatttatcatctcaagttccccttaagagacttctgaacacctggacaaacagatatccagatgctaaaatggacccaatgaacatctgggatgacatcatcacaaatcgatgtttctttctcagcaaaatagaggagaagcttacccctcttccagaagataatagtatgaatgtggatcaagatggagaccccagtgacaggatggaagtgcaagagcaggaagaagatatcagctccctgatcaggagttgcaagttttccatgaaaatgaagatgatagacagtgcccggaagcagaacaatttctcacttgctatgaaactactgaaggagctgcataaagagtcaaaaaccagagacgattggctggtgagctgggtgcagagctactgccgcctgagccactgccggagccggtcccagggctgctctgagcaggtgctcactgtgctgaaaacagtctctttgttggatgagaacaacgtgtcaagctacttaagcaaaaatattctggctttccgtgaccagaacattctcttgggtacaacttacaggatcatagcgaatgctctcagcagtgagccagcctgccttgctgaaatcgaggaggacaaggctagaagaatcttagagctttctggatccagttcagaggattcagagaaggtgatcgcgggtctgtaccagagagcattccagcacctctctgaggctgtgcaggcggctgaggaggaggcccagcctccctcctggagctgtgggcctgcagctggggtgattgatgcttacatgacgctggcagatttctgtgaccaacagctgcgcaaggaggaagagaatgcatcagttattgattctgcagaactgcaggcgtatccagcacttgtggtggagaaaatgttgaaagctttaaaattaaattccaatgaagccagattgaagtttcctagattacttcagattatagaacggtatccagaggagactttgagcctcatgacaaaagagatctcttccgttccctgctggcagttcatcagctggatcagccacatggtggccttactggacaaagaccaagccgttgctgttcagcactctgtggaagaaatcactgataactacccgcaggctattgtttatcccttcatcataagcagcgaaagctattccttcaaggatacttctactggtcataagaataaggagtttgtggcaaggattaaaagtaagttggatcaaggaggagtgattcaagattttattaatgccttagatcagctctctaatcctgaactgctctttaaggattggagcaatgatgtaagagctgaactagcaaaaacccctgtaaataaaaaaaacattgaaaaaatgtatgaaagaatgtatgcagccttgggtgacccaaaggctccaggcctgggggcctttagaaggaagtttattcagacttttggaaaagaatttgataaacattttgggaaaggaggttctaaactactgagaatgaagctcagtgacttcaacgacattaccaacatgctacttttaaaaatgaacaaagactcaaagccccctgggaatctgaaagaatgttcaccctggatgagcgacttcaaagtggagttcctgagaaatgagctggagattcccggtcagtatgacggtaggggaaagccattgccagagtaccacgtgcgaatcgccgggtttgatgagcgggtgacagtcatggcgtctctgcgaaggcccaagcgcatcatcatccgtggccatgacgagagggaacaccctttcctggtgaagggtggcgaggacctgcggcaggaccagcgcgtggagcagctcttccaggtcatgaatgggatcctggcccaagactccgcctgcagccagagggccctgcagctgaggacctatagcgttgtgcccatgacctccaggttaggattaattgagtggcttgaaaatactgttaccttgaaggaccttcttttgaacaccatgtcccaagaggagaaggcggcttacctgagtgatcccagggcaccgccgtgtgaatataaagattggctgacaaaaatgtcaggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggttaaatcaaagataaggttatagtaacatcaaagattaggtgaggtttatagaaagatagatatccaggcttaccaaagtattaagtcaagaatataatatgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaagatacataaaagtgctttgcattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgattggcttttagctttttgttgtttttttttttccttctaacacttgtatttggaggctcttctgtgattttgagaagtatactcttgagtgtttaataaagtttttttccaaaa

SEQ ID NO: 1060 - DNA, 2805 bp, Homo sapiens
acgtcacttccggggcggggcgagcaaggcggaggcggggccggggccggcgggggaggggagcgccaggtccgcgcaggctcgccgggaccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacagttggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttca

SEQ ID NO: 1061 - DNA, 3309 bp, Homo sapiens
acgtcacttccggggcggggcgagcaaggcggaggcggggccggggccggcgggggaggggagcgccaggtccgcgcaggctcgccgggaccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacagttggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttcactgtgggtcactgactttgtgtgatgggggtgtgtggggcggctgggtggggaggaacgtttgtgggattttcatg

SEQ ID NO: 1062 - DNA, 3323 bp, Homo sapiens
acgtcacttccggggcggggcgagcaaggcggaggcggggccggggccggcgggggaggggagcgccaggtccgcgcaggctcgccgggaccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacagttggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggtgagagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaaggtgacttccgatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttcactgtgggtcactgactttgtgtgatgggggtgtgtggggcggctgggtggggaggaacgtttgtgggattttcatg

SEQ ID NO: 1063 - DNA, 3348 bp, Homo sapiens
acgtcacttccggggcggggcgagcaaggcggaggcggggccggggccggcgggggaggggagcgccaggtccgcgcaggctcgccgggaccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacagttggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaatatcctgggagccgggcttttccttaaccccaccctacattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttcactgtgggtcactgactttgtgtgatgggggtgtgtggggcggctgggtggggaggaacgtttgtgggattttcatg

SEQ ID NO: 1064 - DNA, 2271 bp, Homo sapiens
ggcacgagcgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacaattggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctttatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaaaaaaaaaaaaaaaaaaaaa

SEQ ID NO: 1065 - DNA, 1727 bp, Homo sapiens
aatggcaggctcccagggtgatttgagagttgccaggagaggaaggccatttggcaagaatcctgacagacaaaagctggaggagggtagagcaagatggcagaatagaaagcgccaccgatcatactccgcccccacaaggacaccaagttaactacctacacagaagaaataccttcataagaatcaaaaatcaggttctacctcccagatgacatttctagacacaccctgggccagaagagaacccacttccttgaaggaaaggatccagtcctggcagcattcatcgcctgctaactgaagatcccttgggccttgaataccaacagcaatacccaggtactacatcgaagtctttgggtgaacctctgagacttcctggctttaggtagcaacgaagcacggaagaatcttgaccctttgaggaacccgtaactgacgcaagtgccataaatgctactttgattgattctccgccccctccattcttctcttcctgcaattgctctatcacttcttccctctcaagtcccgccctttcagctacctccaactgctgaggaaccggttgcctaaaaggagccggcaaaagcgcctacgtggagtccagaggagcggaagtagtcagatttgactgagagccgtaaagcgcggctggctctcgttttccggataacgactacagctccgactgtcagtgccggccttcctcgtgtgaggggatctgccggacccctgcaaattcaatttctttcccattccgggcccttccctatcgtcgcccccttcaccttggatcatgttcaagaaatttgatgaaaaagaaaatgtgtccaactgcatccagttgaaaacttcagttattaagggtattaagaatcaattgatagagcaatttccaggtattgaaccatggcttaatcaaatcatgcctaagaaagatcctgtcaaaatagtccgatgccatgaacatatagaaatccttacagtaaatggagaattactcttttttagacaaagagaagggcctttttatccaaccctaagattacttcacaaatatccttttatcctgccacaccagcaggttgataaaggagccatcaaatttgtactcagtggagcaaatatcatgtgtccaggcttaacttctcctggagctaagctttaccctgctgcagtagataccattgttgctatcatggcagaaggaaaacagcatgctctatgtgttggagtcatgaagatgtctgcagaagacattgagaaagtcaacaaaggaattggcattgaaaatatccattatttaaatgatgggctgtggcatatgaagacatataaatgagcctcagaaggaatgcacttgggctaaatatggatattgtgctgtatctgtgtttgtgtctgtgtgtgacagcatgaagataatgcctgtggttatgctgaataaattcaccagatgctaaaattctgttagcttcagaaattattttaagttttcttaaactcaagttaaaattgggtagcaaacttggacattaaaaggtatctggtaagtaagcaaactcatacaactaatgtcctttcttaggctaatgatataagagtgaagagcaggacttggtcaatggattgccattttatggtagacctctagagaaactgtctagttaaatggggctagaaactagactaggaattttattctattactccaggggacc

SEQ ID NO: 1066 - DNA, 1355 bp, Homo sapiens
cagaatcttgctgtgtcgcccaggctggactgcagtggtgtaatcttggctcactgcaacctctgcctcccgggttcaagcgattcttgtgcgtcagccttcttgagtacctgggactacaggctcccagggtgatttgagagttgccaggagaggaaggccatttggcaagaatcctgacagacaaaagctggaggagggtagagcaagatggcagaatagaaagcgccaccgatcatactccgcccccacaaggacaccaagttaactacctacacagaagaaataccttcataagaatcaaaaatcagacacaccctgggccagaagagaacccacttccttgaaggaaaggatccagtcctggcagcattcatcgcctgctaactgaagatcccttgggccttgaataccaacagcaatacccagatttgatgaaaaagaaaatgtgtccaactgcatccagttgaaaacttcagttattaagggtattaagaatcaattgatagagcaatttccaggtattgaaccatggcttaatcaaatcatgcctaagaaagatcctgtcaaaatagtccgatgccatgaacatatagaaatccttacagtaaatggagaattactcttttttagacaaagagaagggcctttttatccaaccctaagattacttcacaaatatccttttatcctgccacaccagcaggttgataaaggagccatcaaatttgtactcagtggagcaaatatcatgtgtccaggcttaacttctcctggagctaagctttaccctgctgcagtagataccattgttgctatcatggcagaaggaaaacagcatgctctatgtgttggagtcatgaagatgtctgcagaagacattgagaaagtcaacaaaggaattggcattgaaaatatccattatttaaatgatgggctgtggcatatgaagacatataaatgagcctcagaaggaatgcacttgggctaaatatggatattgtgctgtatctgtgtttgtgtctgtgtgtgacagcatgaagataatgcctgtggttatgctgaataaattcaccagatgctaaaattctgttagcttcagaaattattttaagttttcttaaactcaagttaaaattgggtagcaaacttggacattaaaagatataagagtgaagagcaggacttggtcaatggattgccattttatggtagacctctagagaaactgtctagttaaatggggctagaaactagactaggaattttattctattactccaggggacccagcagtgctcattctcgtgtgtgtgtgtgtgtgtgtgtgtgtatgtgtgtgtgtgtgtgtgtgt

SEQ ID NO: 1067 - DNA, 1336 bp, Homo sapiens
gtagcaacgaagcacggaagaatcttgaccctttgaggaacccgtaactgacgcaagtgccataaatgctactttgattgattctccgccccctccattcttctcttcctgcaattgctctatcacttcttccctctcaagtcccgccctttcagctacctccaactgctgaggaaccggttgcctaaaaggagccggcaaaagcgcctacgtggagtccagaggagcggaagtagtcagatttgactgagagccgtaaagcgcggctggctctcgttttccggataacgactacagctccgactgtcagtgccggccttcctcgtgtgaggggatctgccggacccctgcaaattcaatttctttcccattccgggcccttccctatcgtcgcccccttcaccttggatcatgttcaagaaatttgatgaaaaagaaaatgtgtccaactgcatccagttgaaaacttcagttattaagggtattaagaatcaattgatagagcaatttccaggtattgaaccatggcttaatcaaatcatgcctaagaaagatcctgtcaaaatagtccgatgccatgaacatatagaaatccttacagtaaatggagaattactcttttttagacaaagagaagggcctttttatccaaccctaagattacttcacaaatatccttttatcctgccacaccagcaggttgataaaggagccatcaaatttgtactcagtggagcaaatatcatgtgtccaggcttaacttctcctggagctaagctttaccctgctgcagtagataccattgttgctatcatggcagaaggaaaacagcatgctctatgtgttggagtcatgaagatgtctgcagaagacattgagaaagtcaacaaaggaattggcattgaaaatatccattatttaaatgatgggctgtggcatatgaagacatataaatgagcctcagaaggaatgcacttgggctaaatatggatattgtgctgtatctgtgtttgtgtctgtgtgtgacagcatgaagataatgcctgtggttatgctgaataaattcaccagatgctaaaattctgttagcttcagaaattattttaagttttcttaaactcaagttaaaattgggtagcaaacttggacattaaaaggtatctggtaagtaagcaaactcatacaactaatgtcctttcttaggctaatgatataagagtgaagagcaggacttggtcaatggattgccattttatggtagacctctagagaaactgtctagttaaatggggctagaaactagactaggaattttattctattactccaggggacc

SEQ ID NO: 1068 - DNA, 943 bp, Homo sapiens
gctacctccaactgctgaggaaccggttgcctaaaaggagccggcaaaagcgcctacgtggagtccagaggagcggaagtagtcagatttgactgagagccgtaaagcgcggctggctctcgttttccggataacgactacagctccgactgtcagtgccggccttcctcgtgtgaggggatctgccggacccctgcaaattcaatttctttcccattccgggcccttccctatcgtcgcccccttcaccttggatcatgttcaagaaatttgatgaaaaagaaaatgtgtccaactgcatccagttgaaaacttcagttattaagggtattaagaatcaattgatagagcaatttccaggtattgaaccatggcttaatcaaatcatgcctaagaaagatcctgtcaaaatagtccgatgccatgaacatatagaaatccttacagtaaatggagaattactcttttttagacaaagagaagggcctttttatccaaccctaagattacttcacaaatatccttttatcctgccacaccagcaggttgataaaggagccatcaaatttgtactcagtggagcaaatatcatgtgtccaggcttaacttctcctggagctaagctttaccctgctgcagtagataccattgttgctatcatggcagaaggaaaacagcatgctctatgtgttggagtcatgaagatgtctgcagaagacattgagaaagtcaacaaaggaattggcattgaaaatatccattatttaaatgatgggctgtggcatatgaagacatataaatgagcctcagaaggaatgcacttgggctaaatatggatattgtgctgtatctgtgtttgtgtctgtgtgtgacagcatgaagataatgcctgtggttatgctgaataaattcaccagatgctaaaaaaaaaaaaaaaaaaaaa

SEQ ID NO: 1069 - DNA, 2976 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtatgacagaata

SEQ ID NO: 1070 - DNA, 2974 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggattgctgattctttaaatgtcttgtttcccagatttcaggaaactttttttcttttaagctatccactcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaaaaa

SEQ ID NO: 1071 - DNA, 2799 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggattttgtggattctttgttttgtttcccagatttcaggaaacattttttctttcaagctatcta

SEQ ID NO: 1072 - DNA, 4166 bp, Homo sapiens
gcagttgtgaaaaacttcaggacaaaaatgtttcatttaaggacttgtgctgctaagttgaggccattgacggcttcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagtcatgggacattttttttcgcaacacgaatgccggagccccaccgggcactgcctaccagagtccccttcccctgagccgaggctccctggctgctgtggcccatgcacagtccctggtagaagcacagcccaacgtggacaagctcgtggaggaccacctggcagtgcagtcgctcatcagggcatatcagatacgagggcaccatgtagcacagctggaccccctggggattttggatgctgatctggactcctccgtgcccgctgacattatctcatccacagacaaacttgggttctatggcctggatgagtctgacctcgacaaggtcttccacttgcccaccaccactttcatcgggggacaggaatcagcacttcctctgcgggagatcatccgtcggctggagatggcctactgccagcatattggggtggagttcatgttcatcaatgacctggagcagtgccagtggatccggcagaagtttgagacccctgggatcatgcagttcacaaatgaggagaaacggaccctgctggccaggcttgtgcggtccaccaggtttgaggagttcctacagcggaagtggtcctctgagaagcgctttggtctagaaggctgcgaggtactgatccctgccctcaagaccatcattgacaagtctagtgagaatggcgtggactacgtgatcatgggcatgccacacagagggcggctgaacgtgcttgcaaatgtcatcaggaaggagctggaacagatcttctgtcaattcgattcaaagctggaggcagctgatgagggctccggagatgtgaagtaccacctgggcatgtatcaccgcaggatcaatcgtgtcaccgacaggaacattaccttgtccttggtggccaacccttcccaccttgaggccgctgaccccgtggtgatgggcaagaccaaagccgaacagttttactgtggcgacactgaagggaaaaaggtcatgtccatcctgttgcatggggatgctgcatttgctggccagggcattgtgtacgagaccttccacctcagcgacctgccatcctacacaactcatggcaccgtgcacgtggtcgtcaacaaccagatcggcttcaccaccgaccctcggatggcccgctcctccccctaccccactgacgtggcccgagtggtgaatgcccccattttccacgtgaactcagatgaccccgaggctgtcatgtacgtgtgcaaagtggcggccgagtggaggagcaccttccacaaggacgtggttgtcgatttggtgtgttaccggcgcaacggccacaacgagatggatgagcccatgttcacgcagccgctcatgtacaagcagatccgcaagcagaagcctgtgttacagaagtacgctgagctgctggtgtcgcagggtgtggtcaaccagcctgagtatgaggaggaaatttccaagtatgataagatctgtgaggaagcttttgccagatctaaagatgagaagatcttgcacattaagcactggctggactctccctggcctggcttcttcaccctggacgggcagcccaggagcatgtcctgcccctccacgggtctgacggaggatattctgacacacatcgggaatgtggctagttctgtgcctgtggaaaactttactattcatggagggctgagccggatcttgaagactcgtggggaaatggtgaagaaccggactgtggactgggctctagcggagtacatggcgtttggctcgctcctgaaggagggcatccacattcggctgagcggccaggacgtggagcggggcacattcagccaccgccaccatgtgctccatgaccagaatgtggacaagagaacctgcatccccatgaaccatctctggcccaatcaggccccctatactgtgtgcaacagctcactgtctgagtacggcgtgctgggctttgagctgggcttcgccatggccagtcctaatgccctggtcctctgggaagcccaatttggtgacttccacaacacggcccagtgtatcatcgaccagttcatctgcccgggacaagccaagtgggtgcggcagaatggcatcgtgttgctgctgccccatggcatggagggcatgggtccagaacattcctccgcccgcccagagcggttcttgcagatgtgcaacgatgacccagatgtcctgccagaccttaaagaagccaacttcgacatcaatcagctatatgactgcaattgggttgttgtcaactgctccactcctggcaacttcttccacgtgctacgacgccagatcctgctgccattccggaagccgttaattatcttcacccccaaatccctgttgcgccaccccgaggccagatccagctttgatgagatgcttccaggaacccacttccagcgggtgatcccagaagatggccctgcagctcagaacccagaaaatgtcaaaaggcttctcttctgcaccggcaaagtgtattatgacctcacccgggagcgcaaagcacgcgacatggtggggcaggtggccatcacaaggattgagcagctgtcgccattcccctttgacctcctgctgaaggaggtgcagaagtaccccaatgctgagctggcctggtgccaggaggagcacaagaaccaaggctactatgactacgtgaagccaagacttcggaccaccatcagccgcgccaagcccgtctggtatgccggccgggacccagcggctgctccagccaccggcaacaagaagacccacctgacggagctgcagcgcctcctggacacggccttcgacctggacgtcttcaagaacttctcgtagatgctgcctagggttgcttgggccactgccctctccacacccatgactgccccttgcttctcaactaaagaatagtgcctcagcgctgcccacaccaccgccctcctcgctgtgccaccacccctccctctgctctcataggagttaggctgtcgtccccctccagtgcttggctgccccacaggccacacgctgcccaggctctgctgacttctgagcagttttccaggaggccggggggagcaggaggaggaaaggtagcccccgagggatgtccttggggaggggtcagctctggccacaatcctccccaccagtctcacccactaggataggaactgggccttgtgtgctggcttccgctgtcacccagcaaggcacaggctcctgtatttgagactaggatagcttcatcttgagcctgagccttagaatctgtagaggagcctggagtcggatctagccatggctggcagaggtttctagggtgggccccagccgtggcgtgaactgaggatgacccggggcagctggcaggagagagccttggcctgacctggcacagaaagggcagcttcagtctctgcagtgtccattatctgctgttccttcgagggttccaggctgtgtgtggggcccaagcatgccccacccacccctcctgggcccaggcagcacctggagcccacagagtctgtgtgtagccaggaagccccgctcaggtagccaccgccggggcactggctgctctgtcttggtcctgttaaccctccacctcctctcttggactccctccccaccccaaccactctttctttctcctttaacccaatggagactttctgatgcatcgttttctttgctgtgccaaagcaggtcagaagagggagaggaggggctgggggtgaggggccaggccatggccaaggggccagctgcccctcatttatcactctgaccttcacagggacagatctgatttatttattttggttaaaaaaaaaaaaaaggaacagaaacaactttgcattgcattggcttgacccataaactaagttatatccgtg

SEQ ID NO: 1073 - DNA, 3373 bp, Homo sapiens
gagctgagccggagacaggtaaccgtgcgctgtcgccgcgcccgtcccagtgccgggtgtcgcggcgcttggcggcccggggttggagatcgcggcagttgtgaaaaacttcaggacaaaaatgtttcatttaaggacttgtgctgctaagttgaggccattgacggcttcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagtcatgggacattttttttcgcaacacgaatgccggagccccaccgggcactgcctaccagagtccccttcccctgagccgaggctccctggctgctgtggcccatgcacagtccctggtagaagcacagcccaacgtggacaagctcgtggaggaccacctggcagtgcagtcgctcatcagggcatatcagatacgagggcaccatgtagcacagctggaccccctggggattttggatgctgatctggactcctccgtgcccgctgacattatctcatccacagacaaacttgggttctatggcctggatgagtctgacctcgacaaggtcttccacttgcccaccaccactttcatcgggggacaggaatcagcacttcctctgcgggagatcatccgtcggctggagatggcctactgccagcatattggggtggagttcatgttcatcaatgacctggagcagtgccagtggatccggcagaagtttgagacccctgggatcatgcagttcacaaatgaggagaaacggaccctgctggccaggcttgtgcggtccaccaggtttgaggagttcctacagcggaagtggtcctctgagaagcgctttggtctagaaggctgcgaggtactgatccctgccctcaagaccatcattgacaagtctagtgagaatggcgtggactacgtgatcatgggcatgccacacagagggcggctgaacgtgcttgcaaatgtcatcaggaaggagctggaacagatcttctgtcaattcgattcaaagctggaggcagctgatgagggctccggagatgtgaagtaccacctgggcatgtatcaccgcaggatcaatcgtgtcaccgacaggaacattaccttgtccttggtggccaacccttcccaccttgaggccgctgaccccgtggtgatgggcaagaccaaagccgaacagttttactgtggcgacactgaagggaaaaaggtcatgtccatcctgttgcatggggatgctgcatttgctggccagggcattgtgtacgagaccttccacctcagcgacctgccatcctacacaactcatggcaccgtgcacgtggtcgtcaacaaccagatcggcttcaccaccgaccctcggatggcccgctcctccccctaccccactgacgtggcccgagtggtgaatgcccccattttccacgtgaactcagatgaccccgaggctgtcatgtacgtgtgcaaagtggcggccgagtggaggagcaccttccacaaggacgtggttgtcgatttggtgtgttaccggcgcaacggccacaacgagatggatgagcccatgttcacgcagccgctcatgtacaagcagatccgcaagcagaagcctgtgttacagaagtacgctgagctgctggtgtcgcagggtgtggtcaaccagcctgagtatgaggaggaaatttccaagtatgataagatctgtgaggaagcttttgccagatctaaagatgagaagatcttgcacattaagcactggctggactctccctggcctggcttcttcaccctggacgggcagcccaggagcatgtcctgcccctccacgggtctgacggaggatattctgacacacatcgggaatgtggctagttctgtgcctgtggaaaactttactattcatggagggctgagccggatcttgaagactcgtggggaaatggtgaagaaccggactgtggactgggctctagcggagtacatggcgtttggctcgctcctgaaggagggcatccacattcggctgagcggccaggacgtggagcggggcacattcagccaccgccaccatgtgctccatgaccagaatgtggacaagagaacctgcatccccatgaaccatctctggcccaatcaggccccctatactgtgtgcaacagctcactgtctgagtacggcgtgctgggctttgagctgggcttcgccatggccagtcctaatgccctggtcctctgggaagcccaatttggtgacttccacaacacggcccagtgtatcatcgaccagttcatctgcccgggacaagccaagtgggtgcggcagaatggcatcgtgttgctgctgccccatggcatggagggcatgggtccagaacattcctccgcccgcccagagcggttcttgcagatgtgcaacgatgacccagatgtcctgccagaccttaaagaagccaacttcgacatcaatcagctatatgactgcaattgggttgttgtcaactgctccactcctggcaacttcttccacgtgctacgacgccagatcctgctgccattccggaagccgttaattatcttcacccccaaatccctgttgcgccaccccgaggccagatccagctttgatgagatgcttccaggaacccacttccagcgggtgatcccagaagatggccctgcagctcagaacccagaaaatgtcaaaaggcttctcttctgcaccggcaaagtgtattatgacctcacccgggagcgcaaagcacgcgacatggtggggcaggtggccatcacaaggattgagcagctgtcgccattcccctttgacctcctgctgaaggaggtgcagaagtaccccaatgctgagctggcctggtgccaggaggagcacaagaaccaaggctactatgactacgtgaagccaagacttcggaccaccatcagccgcgccaagcccgtctggtatgccggccgggacccagcggctgctccagccaccggcaacaagaagacccacctgacggagctgcagcgcctcctggacacggccttcgacctggacgtcttcaagaacttctcgtagatgctgcctagggttgcttgggccactgccctctccacacccatctgcccctcatttatcactctgaccttcacagggacagatctgatttatttattttggttaaaaaaaaaaaaaaggaacagaaacaactttgcattgcattggcttgacccataaactaagttatatccgtgggca

SEQ ID NO: 1074 - DNA, 4122 bp, Homo sapiens
cgggttcgggtggagctgagccggagacaggcaattgtgaaaaacttcaggacaaaaatgtttcatttaaggacttgtgctgctaagttgaggccattgacggcttcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagtcatgggacattttttttcgcaacacgaatgccggagccccaccgggcactgcctaccagagtccccttcccctgagccgaggctccctggctgctgtggcccatgcacagtccctggtagaagcacagcccaacgtggacaagctcgtggaggaccacctggcagtgcagtcactcatcagggcatatcagatacgagggcaccatgtagcacagctggaccccctggggattttggatgctgatctggactcctccgtgcccgctgacattatctcatccacagacaaacttgggttctatggcctggatgagtctgacctcgacaaggtcttccacttgcccaccaccactttcatcgggggacaggaatcagcacttcctctgcgggagatcatccgtcggctggagatggcctactgccagcatattggggtggagttcatgttcatcaatgacctggagcagtgccagtggatccggcagaagtttgagacccctgggatcatgcagttcacaaatgaggagaaacggaccctgctggccaggcttgtgcggtccaccaggtttgaggagttcctacagcggaagtggtcctctgagaagcgctttggtctagaaggctgcgaggtactgatccctgccctcaagaccatcattgacaagtctagtgagaatggcgtggactacgtgatcatgggcatgccacacagagggcggctgaacgtgcttgcaaatgtcatcaggaaggagctggaacagatcttctgtcaattcgattcaaagctggaggcagctgatgagggctccggagatgtgaagtaccacctgggcatgtatcaccgcaggatcaatcgtgtcaccgacaggaacattaccttgtccttggtggccaacccttcccaccttgaggccgctgaccccgtggtgatgggcaagaccaaagccgaacagttttactgtggcgacactgaagggaaaaaggtcatgtccatcctgttgcatggggatgctgcatttgctggccagggcattgtgtacgagaccttccacctcagcgacctgccatcctacacaactcatggcaccgtgcacgtggtcgtcaacaaccagatcggcttcaccaccgaccctcggatggcccgctcctccccctaccccactgacgtggcccgagtggtgaatgcccccattttccacgtgaactcagatgaccccgaggctgtcatgtacgtgtgcaaagtggcggccgagtggaggagcaccttccacaaggacgtggttgtcgatttggtgtgttaccggcgcaacggccacaacgagatggatgagcccatgttcacgcagccgctcatgtacaagcagatccgcaagcagaagcctgtgttacagaagtacgctgagctgctggtgtcgcagggtgtggtcaaccagcctgagtatgaggaggaaatttccaagtatgataagatctgtgaggaagcttttgccagatctaaagatgagaagatcttgcacattaagcactggctggactctccctggcctggcttcttcaccctggacgggcagcccaggagcatgtcctgcccctccacgggtctgacggaggatattctgacacacatcgggaatgtggctagttctgtgcctgtggaaaactttactattcatggagggctgagccggatcttgaagactcgtggggaaatggtgaagaaccggactgtggactgggctctagcggagtacatggcgtttggctcgctcctgaaggagggcatccacattcggctgagcggccaggacgtggagcggggcacattcagccaccgccaccatgtgctccatgaccagaatgtggacaagagaacctgcatccccatgaaccatctctggcccaatcaggccccctatactgtgtgcaacagctcactgtctgagtacggcgtgctgggctttgaagctgggcttcgcatggccagtcctaatgccctggtcctctgggaagcccaatttggtgacttccacaacacggcccagtgtatcatcgaccagttcatctgcccgggacaagccaagtgggtgcggcagaatggcatcgtgttgctgctgccccatggcatggagggcatgggtccagaacattcctccgcccgcccagagcggttcttgcagatgtgcaacgatgacccagatgtcctgccagaccttaaagaagccaacttcgacatcaatcagctatatgactgcaattgggttgttgtcaactgctccactcctggcaacttcttccacgtgctacgacgccagatcctgctgccattccggaagccgttaattatcttcacccccaaatccctgttgcgccaccccgaggccagatccagctttgatgagatgcttccaggaacccacttccagcgggtgatcccagaagatggccctgcagctcagaacccagaaaatgtcaaaaggcttctcttctgcaccggcaaagtgtattatgacctcacccgggagcgcaaagcacgcgacatggtggggcaggtggccatcacaaggattgagcagctgtcgccattcccctttgacctcctgctgaaggaggtgcagaagtaccccaatgctgagctggcctggtgccaggaggagcacaagaaccaaggctactatgactacgtgaagccaagacttcggaccaccatcagccgcgccaagcccgtctggtatgccggccggaacccagcggctgctccagccaccggcaacaagaagacccactgacggagctgcagcgcctcctggacacggccttcgacctggacgtcttcaagaacttctcgtagatgctgcctagggttgcttgggccactgccctctccacacccatgactgccccttgcttctcaactaaagaatagtgcctcagcgctgcccacaccaccgtcctcctcgctgtgccaccacccctccctctgctctcataggagttaggctgtcgtccccctccagtgcttggctgccccacaggccacacgctgcccaggctctgctgacttctgagcagttttccaggaggccggggggagcaggaggaggaaaggtagcccccgagggatgtccttggggaggggtcagctctggccccaatcctccccaccagtctcacccactaggataggaactgggccttgtgtgctggcttccgctgtcacccagcaaggcacaggctcctgtatttgagactaggatagcttcatcttgagcctgagccttagaatctgtagaggagcctggagtcggatctagccatggctggcagaggtttctagggtgggccccagccgtggcgtgaactgaggatgacccggggcagctggcaggagagagccttggcctgacctggcacagaaagggcagcttcagtctctgcagtgtccattatctgctgttccttcgagggttccaggctgtgtgtggggcccaagcatgccccacccaccctcctgggcccaggcagcacctggagcccacagagtctgtgtgtagccaggaagccccgctcaggtagccaccgccggggcactggctgctctgtcttggtcctgttaaccctccacctcctctcttggactccctccccaccccaaccactctttctttctcctttaacccaatggagactttctgatgcatcgttttctttgctgtgccaaagcaggtcagaagagggagaggaggggctgggggtgaggggccaggccatggccaaggggccagctgcccctcatttatcactctgaccttcacagggacagatctgatttatttattttggtt

SEQ ID NO: 1075 - DNA, 4260 bp, Homo sapiens
gagctgagccggagacaggtaaccgtgcgctgtcgccgcgcccgtcccagtgccgggtgtcgcggcgcttggcggcccggggttggagatcgcggcagttgtgaaaaacttcaggacaaaaatgtttcatttaaggacttgtgctgctaagttgaggccattgacggcttcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagtcatgggacattttttttcgcaacacgaatgccggagccccaccgggcactgcctaccagagtccccttcccctgagccgaggctccctggctgctgtggcccatgcacagtccctggtagaagcacagcccaacgtggacaagctcgtggaggaccacctggcagtgcagtcgctcatcagggcatatcagatacgagggcaccatgtagcacagctggaccccctggggattttggatgctgatctggactcctccgtgcccgctgacattatctcatccacagacaaacttgggttctatggcctggatgagtctgacctcgacaaggtcttccacttgcccaccaccactttcatcgggggacaggaatcagcacttcctctgcgggagatcatccgtcggctggagatggcctactgccagcatattggggtggagttcatgttcatcaatgacctggagcagtgccagtggatccggcagaagtttgagacccctgggatcatgcagttcacaaatgaggagaaacggaccctgctggccaggcttgtgcggtccaccaggtttgaggagttcctacagcggaagtggtcctctgagaagcgctttggtctagaaggctgcgaggtactgatccctgccctcaagaccatcattgacaagtctagtgagaatggcgtggactacgtgatcatgggcatgccacacagagggcggctgaacgtgcttgcaaatgtcatcaggaaggagctggaacagatcttctgtcaattcgattcaaagctggaggcagctgatgagggctccggagatgtgaagtaccacctgggcatgtatcaccgcaggatcaatcgtgtcaccgacaggaacattaccttgtccttggtggccaacccttcccaccttgaggccgctgaccccgtggtgatgggcaagaccaaagccgaacagttttactgtggcgacactgaagggaaaaaggtcatgtccatcctgttgcatggggatgctgcatttgctggccagggcattgtgtacgagaccttccacctcagcgacctgccatcctacacaactcatggcaccgtgcacgtggtcgtcaacaaccagatcggcttcaccaccgaccctcggatggcccgctcctccccctaccccactgacgtggcccgagtggtgaatgcccccattttccacgtgaactcagatgaccccgaggctgtcatgtacgtgtgcaaagtggcggccgagtggaggagcaccttccacaaggacgtggttgtcgatttggtgtgttaccggcgcaacggccacaacgagatggatgagcccatgttcacgcagccgctcatgtacaagcagatccgcaagcagaagcctgtgttacagaagtacgctgagctgctggtgtcgcagggtgtggtcaaccagcctgagtatgaggaggaaatttccaagtatgataagatctgtgaggaagcttttgccagatctaaagatgagaagatcttgcacattaagcactggctggactctccctggcctggcttcttcaccctggacgggcagcccaggagcatgtcctgcccctccacgggtctgacggaggatattctgacacacatcgggaatgtggctagttctgtgcctgtggaaaactttactattcatggagggctgagccggatcttgaagactcgtggggaaatggtgaagaaccggactgtggactgggctctagcggagtacatggcgtttggctcgctcctgaaggagggcatccacattcggctgagcggccaggacgtggagcggggcacattcagccaccgccaccatgtgctccatgaccagaatgtggacaagagaacctgcatccccatgaaccatctctggcccaatcaggccccctatactgtgtgcaacagctcactgtctgagtacggcgtgctgggctttgagctgggcttcgccatggccagtcctaatgccctggtcctctgggaagcccaatttggtgacttccacaacacggcccagtgtatcatcgaccagttcatctgcccgggacaagccaagtgggtgcggcagaatggcatcgtgttgctgctgccccatggcatggagggcatgggtccagaacattcctccgcccgcccagagcggttcttgcagatgtgcaacgatgacccagatgtcctgccagaccttaaagaagccaacttcgacatcaatcagctatatgactgcaattgggttgttgtcaactgctccactcctggcaacttcttccacgtgctacgacgccagatcctgctgccattccggaagccgttaattatcttcacccccaaatccctgttgcgccaccccgaggccagatccagctttgatgagatgcttccaggaacccacttccagcgggtgatcccagaagatggccctgcagctcagaacccagaaaatgtcaaaaggcttctcttctgcaccggcaaagtgtattatgacctcacccgggagcgcaaagcacgcgacatggtggggcaggtggccatcacaaggattgagcagctgtcgccattcccctttgacctcctgctgaaggaggtgcagaagtaccccaatgctgagctggcctggtgccaggaggagcacaagaaccaaggctactatgactacgtgaagccaagacttcggaccaccatcagccgcgccaagcccgtctggtatgccggccgggacccagcggctgctccagccaccggcaacaagaagacccacctgacggagctgcagcgcctcctggacacggccttcgacctggacgtcttcaagaacttctcgtagatgctgcctagggttgcttgggccactgccctctccacacccatgactgccccttgcttctcaactaaagaatagtgcctcagcgctgcccacaccaccgccctcctcgctgtgccaccacccctccctctgctctcataggagttaggctgtcgtccccctccagtgcttggctgccccacaggccacacgctgcccaggctctgctgacttctgagcagttttccaggaggccggggggagcaggaggaggaaaggtagcccccgagggatgtccttggggaggggtcagctctggccacaatcctccccaccagtctcacccactaggataggaactgggccttgtgtgctggcttccgctgtcacccagcaaggcacaggctcctgtatttgagactaggatagcttcatcttgagcctgagccttagaatctgtagaggagcctggagtcggatctagccatggctggcagaggtttctagggtgggccccagccgtggcgtgaactgaggatgacccggggcagctggcaggagagagccttggcctgacctggcacagaaagggcagcttcagtctctgcagtgtccattatctgctgttccttcgagggttccaggctgtgtgtggggcccaagcatgccccacccacccctcctgggcccaggcagcacctggagcccacagagtctgtgtgtagccaggaagccccgctcaggtagccaccgccggggcactggctgctctgtcttggtcctgttaaccctccacctcctctcttggactccctccccaccccaaccactctttctttctcctttaacccaatggagactttctgatgcatcgttttctttgctgtgccaaagcaggtcagaagagggagaggaggggctgggggtgaggggccaggccatggccaaggggccagctgcccctcatttatcactctgaccttcacagggacagatctgatttatttattttggttaaaaaaaaaaaaaaggaacagaaacaactttgcattgcattggcttgacccataaactaagttatatccgtg

SEQ ID NO: 1076 - DNA, 4253 bp, Homo sapiens
acgccatacgccggggcggggccgagagtttggagccccggagtggggtgtcggcgcctcattcgggtggagctgagccggagacaggcagttgtgaaaaacttcaggacaaaaatgtttcatttaaggacttgtgctgctaagttgaggccattgacggcttcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagtcatgggacattttttttcgcaacacgaatgccggagccccaccgggcactgcctaccagagtccccttcccctgagccgaggctccctggctgctgtggcccatgcacagtccctggtagaagcacagcccaacgtggacaagctcgtggaggaccacctggcagtgcagtcgctcatcagggcatatcagatacgagggcaccatgtagcacagctggaccccctggggattttggatgctgatctggactcctccgtgcccgctgacattatctcatccacagacaaacttgggttctatggcctggatgagtctgacctcgacaaggtcttccacttgcccaccaccactttcatcgggggacaggaatcagcacttcctctgcgggagatcatccgtcggctggagatggcctactgccagcatattggggtggagttcatgttcatcaatgacctggagcagtgccagtggatccggcagaagtttgagacccctgggatcatgcagttcacaaatgaggagaaacggaccctgctggccaggcttgtgcggtccaccaggtttgaggagttcctacagcggaagtggtcctctgagaagcgctttggtctagaaggctgcgaggtactgatccctgccctcaagaccatcattgacaagtctagtgagaatggcgtggactacgtgatcatgggcatgccacacagagggcggctgaacgtgcttgcaaatgtcatcaggaaggagctggaacagatcttctgtcaattcgattcaaagctggaggcagctgatgagggctccggagatgtgaagtaccacctgggcatgtatcaccgcaggatcaatcgtgtcaccgacaggaacattaccttgtccttggtggccaacccttcccaccttgaggccgctgaccccgtggtgatgggcaagaccaaagccgaacagttttactgtggcgacactgaagggaaaaaggtcatgtccatcctgttgcatggggatgctgcatttgctggccagggcattgtgtacgagaccttccacctcagcgacctgccatcctacacaactcatggcaccgtgcacgtggtcgtcaacaaccagatcggcttcaccaccgaccctcggatggcccgctcctccccctaccccactgacgtggcccgagtggtgaatgcccccattttccacgtgaactcagatgaccccgaggctgtcatgtacgtgtgcaaagtggcggccgagtggaggagcaccttccacaaggacgtggttgtcgatttggtgtgttaccggcgcaacggccacaacgagatggatgagcccatgttcacgcagccgctcatgtacaagcagatccgcaagcagaagcctgtgttacagaagtacgctgagctgctggtgtcgcagggtgtggtcaaccagcctgagtatgaggaggaaatttccaagtatgataagatctgtgaggaagcttttgccagatctaaagatgagaagatcttgcacattaagcactggctggactctccctggcctggcttcttcaccctggacgggcagcccaggagcatgtcctgcccctccacgggtctgacggaggatattctgacacacatcgggaatgtggctagttctgtgcctgtggaaaactttactattcatggagggctgagccggatcttgaagactcgtggggaaatggtgaagaaccggactgtggactgggctctagcggagtacatggcgtttggctcgctcctgaaggagggcatccacattcggctgagcggccaggacgtggagcggggcacattcagccaccgccaccatgtgctccatgaccagaatgtggacaagagaacctgcatccccatgaaccatctctggcccaatcaggccccctatactgtgtgcaacagctcactgtctgagtacggcgtgctgggctttgagctgggcttcgccatggccagtcctaatgccctggtcctctgggaagcccaatttggtgacttccacaacacggcccagtgtatcatcgaccagttcatctgcccgggacaagccaagtgggtgcggcagaatggcatcgtgttgctgctgccccatggcatggagggcatgggtccagaacattcctccgcccgcccagagcggttcttgcagatgtgcaacgatgacccagatgtcctgccagaccttaaagaagccaacttcgacatcaatcagctatatgactgcaattgggttgttgtcaactgctccactcctggcaacttcttccacgtgctacgacgccagatcctgctgccattccggaagccgttaattatcttcacccccaaatccctgttgcgccaccccgaggccagatccagctttgatgagatgcttccaggaacccacttccagcgggtgatcccagaagatggccctgcagctcagaacccagaaaatgtcaaaaggcttctcttctgcaccggcaaagtgtattatgacctcacccgggagcgcaaagcacgcgacatggtggggcaggtggccatcacaaggattgagcagctgtcgccattcccctttgacctcctgctgaaggaggtgcagaagtaccccaatgctgagctggcctggtgccaggaggagcacaagaaccaaggctactatgactacgtgaagccaagacttcggaccaccatcagccgcgccaagcccgtctggtatgccggccgggacccagcggctgctccagccaccggcaacaagaagacccacctgacggagctgcagcgcctcctggacacggccttcgacctggacgtcttcaagaacttctcgtagatgctgcctagggttgcttgggccactgccctctccacacccatgactgccccttgcttctcaactaaagaatagtgcctcagcgctgcccacaccaccgccctcctcgctgtgccaccacccctccctctgctctcataggagttaggctgtcgtccccctccagtgcttggctgccccacaggccacacgctgcccaggctctgctgacttctgagcagttttccaggaggccggggggagcaggaggaggaaaggtagcccccgagggatgtccttggggaggggtcagctctggccacaatcctccccaccagtctcacccactaggataggaactgggccttgtgtgctggcttccgctgtcacccagcaaggcacaggctcctgtatttgagactaggatagcttcatcttgagcctgagccttagaatctgtagaggagcctggagtcggatctagccatggctggcagaggtttctagggtgggccccagccgtggcgtgaactgaggatgacccggggcagctggcaggagagagccttggcctgacctggcacagaaagggcagcttcagtctctgcagtgtccattatctgctgttccttcgagggttccaggctgtgtgtggggcccaagcatgccccacccacccctcctgggcccaggcagcacctggagcccacagagtctgtgtgtagccaggaagccccgctcaggtagccaccgccggggcactggctgctctgtcttggtcctgttaaccctccacctcctctcttggactccctccccaccccaaccactctttctttctcctttaacccaatggagactttctgatgcatcgttttctttgctgtgccaaagcaggtcagaagagggagaggaggggctgggggtgaggggccaggccatggccaaggggccagctgcccctcatttatcactctgaccttcacagggacagatctgatttatttattttggttaaaaaaaaaaaaaaggaacagaaacaactttgcattgcattggcttgacccataaactaagttatatccgtg

SEQ ID NO: 1077 - DNA, 2384 bp, Homo sapiens
gagcagtcggagccgcagctgcctcccggagcccgagcccctccctccgggtccggcctagcccgcctgactcccactctgatcacctccacagcccgccgacctgagaactactacgcccatgagccttcgcggcgccggtgatttaggggacgctcctcagtgccccctgcgaccgccagagagaactacgttgcccctcagcccgagaggcgcgagtggtggaaaacctctccatcatactccgccctcgagacaccagccccctccatgacgtcttcagccgcgcgcccgacgtcggctgagacggccatagacactggcggctagaggggcccggacttgccctcccagctctaacttccgccggaagtgccttccagccgcaggcgcccttcttcttctgtgcgctcgggctcctggtcccggctccccggttaccggggcgcgagtatgaccacaatggcggccgccaccctgctgcgcgcgacgccccacttcagcggtctcgccgccggccggaccttcctgctgcagggtctgttgcggctgctgaaagccccggcattgcctctcttgtgccgcggcctggccgtggaggccaagaagacttacgtgcgcgacaagccacatgtgaatgtgggtaccatcggccatgtggaccacgggaagaccacgctgactgcagccatcacgaagattctagctgagggaggtggggctaagttcaagaagtacgaggagattgacaatgccccggaggagcgagctcggggtatcaccatcaatgcggctcatgtggagtatagcactgccgcccgccactacgcccacacagactgcccgggtcatgcagattatgttaagaatatgatcacaggcactgcacccctcgacggctgcatcctggtggtagcagccaatgacggccccatgccccagacccgagagcacttattactggccagacagattggggtggagcatgtggtggtgtatgtgaacaaggctgacgctgtccaggactctgagatggtggaactggtggaactggagatccgggagctgctcaccgagtttggctataaaggggaggagaccccagtcatcgtaggctctgctctctgtgcccttgagggtcgggaccctgagttaggcctgaagtctgtgcagaagctactggatgctgtggacacttacatcccagtgcccgcccgggacctggagaagcctttcctgctgcctgtggaggcggtgtactccgtccctggccgtggcaccgtggtgacaggtacactagagcgtggcattttaaagaagggagacgagtgtgagctcctaggacatagcaagaacatccgcactgtggtgacaggcattgagatgttccacaagagcctggagagggccgaggccggagataacctcggggccctggtccgaggcttgaagcgggaggacttgcggcggggcctggtcatggtcaagccaggttccatcaagccccaccagaaggtggaggcccaggtttacatcctcagcaaggaggaaggtggccgccacaagccctttgtgtcccacttcatgcctgtcatgttctccctgacttgggacatggcctgtcggattatcctgcccccagagaaggagcttgccatgcccggggaggacctgaagttcaacctaatcttgcggcagccaatgatcttagagaaaggccagcgtttcaccctgcgagatggcaaccggactattggcaccggtctagtcaccaacacgctggccatgactgaggaggagaagaatatcaaatggggttgagtgtgcagatctctgctcagcttcccttgcgtttaaggcctgccctagccagggctccctcctgcttccagtaccctctcatggcataggctgcaacccagcagagggcagctagatggacatttcccctgctcggaagggttggcctgcctggctggggaggtcagtaaactttgaatagtaagccagcctgtgtcctgtgtcctttgtgcaaattggagaggataggggaggacaaaaagggtgttgaaccccagacagatggggagcttgtgagatcccagagcagttttaacggataaatcaagtccagtgagcttagtgattgcctagacacagtaggatgccgttattcagcctcctgggagatagtgggaaagaatgttctatcgctctggagccagcatggcttcagctcaggtgccaaacccatcttgtttcctcggaatactaagtgaatgtctagcatccattcacattctgtgggaacagggactggacaggcatacctcagatgctgtaggtttgcttccagactaccacaataaagcaggtcacaaatt

SEQ ID NO: 1078 - DNA, 2512 bp, Homo sapiens
gagcagtcggagccgcagctgcctcccggagcccgagcccctccctccgggtccggcctagcccgcctgactcccactctgatcacctccacagcccgccgacctgagaactactacgcccatgagccttcgcggcgccggtgatttaggggacgctcctcagtgccccctgcgaccgccagagagaactacgttgcccctcagcccgagaggcgcgagtggtggaaaacctctccatcatactccgccctcgagacaccagccccctccatgacgtcttcagccgcgcgcccgacgtcggctgagacggccatagacactggcggctagaggggcccggacttgccctcccagctctaacttccgccggaagtgccttccagccgcaggcgcccttcttcttctgtgcgctcgggctcctggtcccggctccccggttaccggggcgcgagtatgaccacaatggcggccgccaccctgctgcgcgcgacgccccacttcagcggtctcgccgccggccggaccttcctgctgcagggtctgttgcggctgctgaaagccccggcattgcctctcttgtgccgcggcctggccgtggaggccaagaagacttacgtgcgcgacaagccacatgtgaatgtgggtaccatcggccatgtggaccacgggaagaccacgctgactgcagccatcacgaagattctagctgagggaggtggggctaagttcaagaagtacgaggagattgacaatgccccggaggagcgagctcggggtatcaccatcaatgcggctcatgtggagtatagcactgccgcccgccactacgcccacacagactgcccgggtcatgcagattatgttaagaatatgatcacaggcactgcacccctcgacggctgcatcctggtggtagcagccaatgacggccccatgccccagacccgagagcacttattactggccagacagattggggtggagcatgtggtggtgtatgtgaacaaggctgacgctgtccaggactctgagatggtggaactggtggaactggagatccgggagctgctcaccgagtttggctataaaggggaggagaccccagtcatcgtaggctctgctctctgtgcccttgagggtcgggaccctgagttaggcctgaagtctgtgcagaagctactggatgctgtggacacttacatcccagtgcccgcccgggacctggagaagcctttcctgctgcctgtggaggcggtgtactccgtccctggccgtggcaccgtggtgacaggtacactagagcgtggcattttaaagaagggagacgagtgtgagctcctaggacatagcaagaacatccgcactgtggtgacaggtttgggaagccagtctggagagcagggcctggctgaagggtggccttaccccggcagatcccttgtgccttccctctgtctcacattcgccttccttctccctgctccttttccctttccgtcctaggcattgagatgttccacaagagcctggagagggccgaggccggagataacctcggggccctggtccgaggcttgaagcgggaggacttgcggcggggcctggtcatggtcaagccaggttccatcaagccccaccagaaggtggaggcccaggtttacatcctcagcaaggaggaaggtggccgccacaagccctttgtgtcccacttcatgcctgtcatgttctccctgacttgggacatggcctgtcggattatcctgcccccagagaaggagcttgccatgcccggggaggacctgaagttcaacctaatcttgcggcagccaatgatcttagagaaaggccagcgtttcaccctgcgagatggcaaccggactattggcaccggtctagtcaccaacacgctggccatgactgaggaggagaagaatatcaaatggggttgagtgtgcagatctctgctcagcttcccttgcgtttaaggcctgccctagccagggctccctcctgcttccagtaccctctcatggcataggctgcaacccagcagagggcagctagatggacatttcccctgctcggaagggttggcctgcctggctggggaggtcagtaaactttgaatagtaagccagcctgtgtcctgtgtcctttgtgcaaattggagaggataggggaggacaaaaagggtgttgaaccccagacagatggggagcttgtgagatcccagagcagttttaacggataaatcaagtccagtgagcttagtgattgcctagacacagtaggatgccgttattcagcctcctgggagatagtgggaaagaatgttctatcgctctggagccagcatggcttcagctcaggtgccaaacccatcttgtttcctcggaatactaagtgaatgtctagcatccattcacattctgtgggaacagggactggacaggcatacctcagatgctgtaggtttgcttccagactaccacaataaagcaggtcacaaatt

SEQ ID NO: 1079 - DNA, 1627 bp, Homo sapiens
cttctgtgcgctcgggctcctggtcccggctccccggttaccggggcgcgagtatgaccacaatggcggccgccaccctgctgcgcgcgacgccccacttcagcggtctcgccgccggccggaccttcctgctgcagggtctgttgcggctgctgaaagccccggcattgcctctcttgtgccgcggcctggccgtggaggccaagaagacttacgtgcgcgacaagccacatgtgaatgtgggtaccatcggccatgtggaccacgggaagaccacgctgactgcagccatcacgaagattctagctgagggaggtggggctaagttcaagaagtacgaggagattgacaatgccccggaggagcgagctcggggtatcaccatcaatgcggctcatgtggagtatagcactgccgcccgccactacgcccacacagactgcccgggtcatgcagattatgttaagaatatgatcacaggcactgcacccctcgacggctgcatcctggtggtagcagccaatgacggccccatgccccagacccgagagcacttattactggccagacagattggggtggagcatgtggtggtgtatgtgaacaaggctgacgctgtccaggactctgagatggtggaactggtggaactggagatccgggagctgctcaccgagtttggctataaaggggaggagaccccagtcatcgtaggctctgctctctgtgcccttgagggtcgggaccctgagttaggcctgaagtctgtgcagaagctactggatgctgtggacacttacatcccagtgcccgcccgggacctggagaagcctttcctgctgcctgtggaggcggtgtactccgtccctggccgtggcaccgtggtgacaggtacactagagcgtggcattttaaagaagggagacgagtgtgagctcctaggacatagcaagaacatccgcactgtggtgacaggcattgagatgttccacaagagcctggagagggccgaggccggagataacctcggggccctggtccgaggcttgaagcgggaggacttgcggcggggcctggtcatggtcaagccaggttccatcaagccccaccagaaggtggaggcccaggtttacatcctcagcaaggaggaaggtggccgccacaagccctttgtgtcccacttcatgcctgtcatgttctccctgacttgggacatggcctgtcggattatcctgcccccagagaaggagcttgccatgcccggggaggacctgaagttcaacctaatcttgcggcagccaatgatcttagagaaaggccagcgtttcaccctgcgagatggcaaccggactattggcaccggtctagtcaccaacacgctggccatgactgaggaggagaagaatatcaaatggggttgagtgtgcagatctctgctcagcttcccttgcgtttaaggcctgccctagccagggctccctcctgcttccagtaccctctcatggcataggctgcaacccagcagagggcagctagatggacatttcccctgctcggaagggttggcctgcctggctggggaggtcagtaaactttgaatagtaaaaaaaaaaaaaaaaaaaaaaaa

SEQ ID NO: 1080 - DNA, 5362 bp, Homo sapiens
tttatagcagcagcagaaatataccaccctagaggacacacctccttttagctaggtacctataaatgtccaggattttctattcaattgagaagaacccagcaaaatggggatctccacagtcatccttgaaatgtgtcttttatggggacaagttctatctacaggtgggtggatcccaaggactacagactacgcttcactgattccctcggaggtgcccttggatacaactgtagcagaaggttctccatttccctcggagttgaccctggagtcaactgtagcagaaggttctccgatttccttggagtcaaccctggagtcaactgtagcagaaggttctctgattccctcagagtcaaccctggagtcaactgtagcagaaggatctgattctggtttggccctgaggctggtgaatggagatggcaggtgtcagggccgagtggagatcctataccgaggctcctggggcaccgtgtgtgatgacagctgggacaccaatgatgccaacgtggtctgtaggcagctgggttgtggctgggccatgtcagctccaggaaatgcctggtttggccagggctcaggacccattgccctggatgatgtgcgctgctcaggacacgaatcctacctgtggagctgcccccacaatggctggctctcccataactgtggccatggtgaagatgctggtgttatctgctcagctgcccagcctcagtcaacactcaggccagaaagttggcctgtcaggatatcaccacctgtacccacagaaggatctgaatccagtttggccctgaggctggtgaatggaggcgacaggtgtcgaggccgagtggaggtcctataccgaggctcctggggcaccgtgtgtgatgactactgggacaccaatgatgccaatgtggtctgcaggcagctgggctgtggctgggccatgtcagccccaggaaatgcccagtttggccagggctcaggacccattgtcctggatgatgtgcgctgctcaggacacgagtcctacctgtggagctgcccccacaatggctggctcacccacaactgtggccatagtgaagacgctggtgtcatctgctcagctccccagtcccggccgacacccagcccaggatctgaatccagtttggccctgaggctggtgaatggaggtgacaggtgtcagggccgagtggaggtcctataccgaggctcctggggcaccgtgtgtgatgatagctgggacaccagtgacgccaatgtggtctgccggcagctgggctgtggctgggccacgtcagccccaggaaatgcccggtttggccagggttcaggacccattgtcctggatgacgtgcgctgctcaggctatgagtcctacctgtggagctgcccccacaatggctggctctcccataactgtcagcacagtgaagacgctggtgtcatctgctcagctgcccactcctggtcgacgcccagtccagacacattgccgaccatcaccttgcctgcatcgacagtaggatctgaatccagtttggccctgaggctggtgaatggaggtgacaggtgtcagggccgagtggaggtcctataccaaggctcctggggcaccgtgtgcgatgacagctgggacaccaatgatgccaatgtcgtctgcaggcaactgggctgtggctgggccatgtcagccccaggaaatgcccggtttggtcagggctcaggacccattgtcctggatgatgtgcgctgctcaggacacgagtcttacctgtggagctgcccccacaatggctggctctcccacaactgtggccatagtgaagacgctggtgtcatctgctcagcttcccagtcccggccaacacctagtccagacacttggccaacctcacatgcatcaacagcaggaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccacgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccaggatctgaatccactttggccctgagactggtgaatggaggtgacaggtgtcgaggccgagtggaggtcctataccaaggctcctggggcaccgtgtgtgatgactactgggacaccaatgatgccaacgtggtctgcaggcagctgggctgtggctgggccatgtcagccccaggaaatgcccagtttggccagggctcaggacccattgtcctggatgatgtgcgctgctcaggacacgagtcttacctgtggagctgcccccacaatggctggctctcccacaactgtggccatcatgaagatgctggtgtcatctgctcagctgctcagtcccagtcaacgcccaggccagatacttggctgaccaccaacttaccggcattgacagtaggatctgaatccagtttggctctgaggctggtgaatggaggtgacaggtgtcgaggccgagtggaggtcctgtatcgaggctcctggggaaccgtgtgtgatgacagctgggacaccaatgatgccaatgtggtctgcaggcagctgggctgtggctgggccatgtcggccccaggaaatgcccggtttggccagggctcaggacccattgtcctggatgatgtgcgctgctcagggaatgagtcctacctgtggagctgcccccacaaaggctggctcacccacaactgtggccatcacgaagacgctggtgtcatctgctcagccacccaaataaattctactacgacagattggtggcatccaacaactacaaccactgcaagaccctcttcaaattgtggtggcttcttattctatgccagtgggacattctccagcccatcctaccctgcatactaccccaacaatgctaagtgtgtttgggaaatagaagtgaattctggttatcgcataaacctgggcttcagtaatctgaaattggaggcacaccataactgcagttttgattatgttgaaatctttgatggatcattgaatagcagtctcctgctggggaaaatctgtaatgataccaggcaaatatttacatcttcttacaaccgaatgaccattcactttcgaagtgacatcagtttccaaaacactggctttttggcttggtataactccttcccaagcgatgccaccttgaggttggtcaatttaaattcatcctatggtctatgtgccgggcgtgtagaaatttaccatggtggcacctgggggacagtttgtgatgactcctggaccattcaggaagctgaggtggtctgcagacagctagggtgtggacgtgcagtttcagcccttggaaatgcatattttggctctggctctggccccatcaccctggacgatgtagagtgctcagggacggaatccactctctggcagtgccggaaccgaggctggttctcccacaactgtaatcatcgtgaagatgctggtgtcatctgctcaggaaaccatctatcgacacctgctccttttctcaacatcacccgtccaaacacagattattcctgcggaggcttcctatcccaaccatcaggggacttttccagcccattctatcccgggaactatccaaacaatgccaagtgtgtgtgggacattgaggtgcaaaacaactaccgtgtgactgtgatcttcagagatgtccagcttgaaggtggctgcaactatgattatattgaagttttcgatggcccctaccgcagttcccctctcattgctcgagtttgtgatggggccagaggctccttcacttcttcctccaacttcatgtccattcgcttcatcagtgaccacagcatcacaaggagagggttccgggctgagtactactccagtccctccaatgacagcaccaacctgctctgtctgccaaatcacatgcaagccagtgtgagcaggagctatctccaatccttgggcttttctgccagtgaccttgtcatttccacctggaatggatactacgagtgtcggccccagataacgccgaacctggtgatattcacaattccctactcaggctgcggcaccttcaagcaggcagacaatgacaccatcgactattccaacttcctcacagcagctgtctcaggtggcatcatcaagaggaggacagacctccgtattcacgtcagctgcagaatgcttcagaacacctgggtcgacaccatgtacattgctaatgacaccatccacgttgctaataacaccatccaggtcgaggaagtccagtatggcaattttgacgtgaacatttccttttatacttcctcatctttcttgtatcctgtgaccagccgcccttactacgtggacctgaaccaggacttgtacgttcaggctgaaatcctccattctgatgctgtactgaccttgtttgtggacacctgcgtggcatcaccatactccaatgacttcacgtctttgacttatgatctaatccggagtggatgcgtgagggatgacacctacggaccctactcctcgccatctcttcgcattgcccgcttccggttcagggccttccacttcctgaaccgcttcccctccgtgtacctgcgttgtaaaatggtggtgtgcagagcgtatgacccctcttcccgctgctaccgaggctgtgtgttgaggtcgaagagggatgtgggctcctaccaggaaaaggtggacgtcgtcctgggtcccatccagctgcagacccccccacgccgagaagaggagcctcggtaggtggtcgctctcagaccccactgtccaccggggcgcagacccctgactcggggacttgggatgttcctcttggtgtcatattccaactcagattgagccctacattgtgctgcacctggtcatacggagttgaatcagacctggttcccgcctcccccaaggctcatggtccttggaggacccgttgcagggcgaggtcaagagagttctgacctggatggcccatagacctgacgtcccagaatccatgcttctcatctgcaaaatgaaaatgtcaatacttacttcttagcactgttgagagggttacttacataaaggaattttggtgaaactgcctcagcctgt

SEQ ID NO: 1081 - DNA, 5415 bp, Homo sapiens
tttatagcagcagcagaaatataccaccctagaggacacacctccttttagctaggtacctataaatgtccaggattttctattcaattgagaagaacccagcaaaatggggatctccacagtcatccttgaaatgtgtcttttatggggacaagttctatctacaggtgggtggatcccaaggactacagactacgcttcactgattccctcggaggtgcccttggatacaactgtagcagaaggttctccatttccctcggagttgaccctggagtcaactgtagcagaaggttctccgatttccttggagtcaaccctggagtcaactgtagcagaaggttctctgattccctcagagtcaaccctggagtcaactgtagcagaaggatctgattctggtttggccctgaggctggtgaatggagatggcaggtgtcagggccgagtggagatcctataccgaggctcctggggcaccgtgtgtgatgacagctgggacaccaatgatgccaacgtggtctgtaggcagctgggttgtggctgggccatgtcagctccaggaaatgcctggtttggccagggctcaggacccattgccctggatgatgtgcgctgctcaggacacgaatcctacctgtggagctgcccccacaatggctggctctcccataactgtggccatggtgaagatgctggtgttatctgctcagctgcccagcctcagtcaacactcaggccagaaagttggcctgtcaggatatcaccacctgtacccacagaaggatctgaatccagtttggccctgaggctggtgaatggaggcgacaggtgtcgaggccgagtggaggtcctataccgaggctcctggggcaccgtgtgtgatgactactgggacaccaatgatgccaatgtggtctgcaggcagctgggctgtggctgggccatgtcagccccaggaaatgcccagtttggccagggctcaggacccattgtcctggatgatgtgcgctgctcaggacacgagtcctacctgtggagctgcccccacaatggctggctcacccacaactgtggccatagtgaagacgctggtgtcatctgctcagctccccagtcccggccgacacccagcccagatacttggccgacctcacatgcatcaacagcaggatctgaatccagtttggccctgaggctggtgaatggaggtgacaggtgtcagggccgagtggaggtcctataccgaggctcctggggcaccgtgtgtgatgatagctgggacaccagtgacgccaatgtggtctgccggcagctgggctgtggctgggccacgtcagccccaggaaatgcccggtttggccagggttcaggacccattgtcctggatgacgtgcgctgctcaggctatgagtcctacctgtggagctgcccccacaatggctggctctcccataactgtcagcacagtgaagacgctggtgtcatctgctcagctgcccactcctggtcgacgcccagtccagacacattgccgaccatcaccttgcctgcatcgacagtaggatctgaatccagtttggccctgaggctggtgaatggaggtgacaggtgtcagggccgagtggaggtcctataccaaggctcctggggcaccgtgtgcgatgacagctgggacaccaatgatgccaatgtcgtctgcaggcaactgggctgtggctgggccatgtcagccccaggaaatgcccggtttggtcagggctcaggacccattgtcctggatgatgtgcgctgctcaggacacgagtcttacctgtggagctgcccccacaatggctggctctcccacaactgtggccatagtgaagacgctggtgtcatctgctcagcttcccagtcccggccaacacctagtccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccacgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctctcgtgcatcaacagcaggatctgaatccactttggccctgagactggtgaatggaggtgacaggtgtcgaggccgagtggaggtcctataccaaggctcctggggcaccgtgtgtgatgactactgggacaccaatgatgccaacgtggtctgcaggcagctgggctgtggctgggccatgtcagccccaggaaatgcccagtttggccagggctcaggacccattgtcctggatgatgtgcgctgctcaggacacgagtcttacctgtggagctgcccccacaatggctggctctcccacaactgtggccatcatgaagatgctggtgtcatctgctcagctgctcagtcccagtcaacgcccaggccagatacttggctgaccaccaacttaccggcattgacagtaggatctgaatccagtttggctctgaggctggtgaatggaggtgacaggtgtcgaggccgagtggaggtcctgtatcgaggctcctggggaaccgtgtgtgatgacagctgggacaccaatgatgccaatgtggtctgcaggcagctgggctgtggctgggccatgtcggccccaggaaatgcccggtttggccagggctcaggacccattgtcctggatgatgtgcgctgctcagggaatgagtcctacctgtggagctgcccccacaaaggctggctcacccacaactgtggccatcacgaagacgctggtgtcatctgctcagccacccaaataaattctactacgacagattggtggcatccaacaactacaaccactgcaagaccctcttcaaattgtggtggcttcttattctatgccagtgggacattctccagcccatcctaccctgcatactaccccaacaatgctaagtgtgtttgggaaatagaagtgaattctggttatcgcataaacctgggcttcagtaatctgaaattggaggcacaccataactgcagttttgattatgttgaaatctttgatggatcattgaatagcagtctcctgctggggaaaatctgtaatgataccaggcaaatatttacatcttcttacaaccgaatgaccattcactttcgaagtgacatcagtttccaaaacactggctttttggcttggtataactccttcccaagcgatgccaccttgaggttggtcaatttaaattcatcctatggtctatgtgccgggcgtgtagaaatttaccatggtggcacctgggggacagtttgtgatgactcctggaccattcaggaagctgaggtggtctgcagacagctagggtgtggacgtgcagtttcagcccttggaaatgcatattttggctctggctctggccccatcaccctggacgatgtagagtgctcagggacggaatccactctctggcagtgccggaaccgaggctggttctcccacaactgtaatcatcgtgaagatgctggtgtcatctgctcaggaaaccatctatcgacacctgctccttttctcaacatcacccgtccaaacacagattattcctgcggaggcttcctatcccaaccatcaggggacttttccagcccattctatcccgggaactatccaaacaatgccaagtgtgtgtgggacattgaggtgcaaaacaactaccgtgtgactgtgatcttcagagatgtccagcttgaaggtggctgcaactatgattatattgaagttttcgatggcccctaccgcagttcccctctcattgctcgagtttgtgatggggccagaggctccttcacttcttcctccaacttcatgtccattcgcttcatcagtgaccacagcatcacaaggagagggttccgggctgagtactactccagtccctccaatgacagcaccaacctgctctgtctgccaaatcacatgcaagccagtgtgagcaggagctatctccaatccttgggcttttctgccagtgaccttgtcatttccacctggaatggatactacgagtgtcggccccagataacgccgaacctggtgatattcacaattccctactcaggctgcggcaccttcaagcaggcagacaatgacaccatcgactattccaacttcctcacagcagctgtctcaggtggcatcatcaagaggaggacagacctccgtattcacgtcagctgcagaatgcttcagaacacctgggtcgacaccatgtacattgctaatgacaccatccacgttgctaataacaccatccaggtcgaggaagtccagtatggcaattttgacgtgaacatttccttttatacttcctcatctttcttgtatcctgtgaccagccgcccttactacgtggacctgaaccaggacttgtacgttcaggctgaaatcctccattctgatgctgtactgaccttgtttgtggacacctgcgtggcatcaccatactccaatgacttcacgtctttgacttatgatctaatccggagtggatgcgtgagggatgacacctacggaccctactcctcgccatctcttcgcattgcccgcttccggttcagggccttccacttcctgaaccgcttcccctccgtgtacctgcgttgtaaaatggtggtgtgcagagcgtatgacccctcttcccgctgctaccgaggctgtgtgttgaggtcgaagagggatgtgggctcctaccaggaaaaggtggacgtcgtcctgggtcccatccagctgcagacccccccacgccgagaagaggagcctcggtaggtggtcgctctcagaccccactgtccaccggggcgcagacccctgactcggggacttgggatgttcctcttggtgtcatattccaactcagattgagccctacattgtgctgcacctggtcatacggagttgaatcagacctggttcccgcctcccccaaggctcatggtccttggaggacccgttgcagggcgaggtcaagagagttctgacctggatggcccatagacctgacgtcccagaatccatgcttctcatctgcaaaatgaaaatgtcaatacttacttcttagcactgttgagagggttacttacataaaggaattttggtgaaactgc

SEQ ID NO: 1082 - DNA, 7656 bp, Homo sapiens
tttatagcagcagcagaaatataccaccctagaggacacacctccttttagctaggtacctataaatgtccaggattttctattcaattgagaagaacccagcaaaatggggatctccacagtcatccttgaaatgtgtcttttatggggacaagttctatctacaggtgggtggatcccaaggactacagactacgcttcactgattccctcggaggtgcccttggatacaactgtagcagaaggttctccatttccctcggagttgaccctggagtcaactgcagcagaaggttctccgatttccttggagtcaaccctggagtcaactgtagcagaaggttctctgattccctcagagtcaaccctggagtcaactgtagcagaaggatctgattctggtttggccctgaggctggtgaatggagatggcaggtgtcagggccgagtggagatcctataccgaggctcctggggcaccgtgtgtgatgacagctgggacaccaatgatgccaacgtggtctgtaggcagctgggttgtggctgggccatgtcagctccaggaaatgcctggtttggccagggctcaggacccattgccctggatgatgtgcgctgctcaggacacgaatcctacctgtggagctgcccccacaatggctggctctcccataactgtggccatggtgaagatgctggtgttatctgctcagctgcccagcctcagtcaacactcaggccagaaagttggcctgtcaggatatcaccacctgtacccacagaaggatctgaatccagtttggccctgaggctggtgaatggaggcgacaggtgtcgaggccgagtggaggtcctataccgaggctcctggggcaccgtgtgtgatgactactgggacaccaatgatgccaatgtggtctgcaggcagctgggctgtggctgggccatgtcagccccaggaaatgcccagtttggccagggctcaggacccattgtcctggatgatgtgcgctgctcaggacacgagtcctacctgtggagctgcccccacaatggctggctcacccacaactgtggccatagtgaagacgctggtgtcatctgctcagctcccctgtcccggccgacacccagcccagatacttggccgacctcacatgcatcaacagcaggacctgaatccagtttggccctgaggctggtgaatggaggtgacaggtgtcagggccgagtggaggtcctataccgaggctcctggggcaccgtgtgtgatgatagctgggacaccagtgacgccaatgtggtctgccggcagctgggctgtggctgggccacgtcagccccaggaaatgcccggtttggccagggttcaggacccattgtcctggatgacgtgcgctgctcaggctatgagtcctacctgtggagctgcccccacaatggctggctctcccataactgtcagcacagtgaagacgctggtgtcatctgctcagacacgttgccgaccatcaccttacctgcatcgacagtaggatctgaatccagtttggccctgaggctggtgaatggaggtgacaggtgtcagggccgagtggaggtcctataccgaggctcctggggcaccgtgtgtgatgacagctgggacaccaatgatgccaatgtggtctgcaggcagctgggctgtggctgggccatgttggccccaggaaatgcccggtttggtcagggctcaggacccattgtcctggatgacgtgcgctgctcagggaatgagtcctacttgtggagctgcccccacaatggctggctctcccataactgtggccatagtgaagacgctggtgtcatctgctcaggacctgaatccagtttggccctggggctggtgaatggaggtgacaggtgtcagggccgagtggaggtcctataccgaggctcttggggcaccgtgtgtgatgacagctgggacaccaatgatgccaatgtggtctgcaggcagctgggctgtggctgggccacgtcagccccaggaaatgcccggtttggtcagggctcaggacccattgtcctggatgatgtgcgctgctcaggacatgagtcctacctgtggagctgccccaacaatggctggctctcccacaactgtggccatcatgaagatgctggtgtcatctgctcagctgcccagtcccggtcgacgcccaggccagacacgttgtcgaccatcacgttacctccatcgacagtaggatctgaatccagtttgaccctgaggctggtgaatggaagtgacaggtgtcagggccgagtagaggtcctataccgaggctcctggggcaccgtgtgtgatgacagctgggataccaatgatgccaatgtggtctgcaggcagctgggctgtggctgggccacgtcggccccaggaaatgcccggtttggccagggctcaggacccattgttctggatgatgtgcgctgctcaggacacgagtcctacctgtggagctgcccccacaatggctggctctcccacaactgtggccatcatgaagatgctggtgtcatctgctcagtttcccagtcccggccgacacccagtccagatacttggccgacctcacatgcatcaacagcaggatctgaatccagtttggccctgaggctggtgaatggaggtgacaggtgtcagggccgagtggaggtcctataccgaggctcctggggcaccgtgtgtgatgatagctgggacaccagtgacgccaatgtggtctgccggcggctgggctgtggctgggccacgtcagccccaggaaatgcccggtttggccagggttcaggacccattgtcctggatgacgtgcgctgctcaggctatgagtcctacctgtggagctgcccccacaatggctggctctcccataactgtcagcacagtgaagacgctggtgtcatctgctcagctgcccactcctggtcgacgcccagtccagacacattgccgaccatcaccttgcctgcatcgacagtaggatctgaatccagtttggccctgaggctggtgaatggaggtgacaggtgtcagggccgagtggaggtcctataccaaggctcctggggcaccgtgtgcgatgacagctgggacaccaatgatgccaatgtcgtctgcaggcaactgggctgtggctgggccatgtcagccccaggaaatgcccggtttggtcagggctcaggacccattgtcctggatgatgtgcgctgctcaggacacgagtcttacctgtggagctgcccccacaatggctggctctcccacaactgtggccatagtgaagacgctggtgtcatctgctcagcttcccagtcccggccaacacctagtccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccatgtcagccccaggaaatgcccggtttggccagggttcaggacccattgtcctggatgatgtgcgctgctcaggacatgagtcctatctgtggagttgcccccacgatggctggctctcccacaactgtggccatcatgaagacgctggtgtcatctgctcagcttcccagtcccagccgacacccagcccagacacttggccaacctcacatgcatcaacagcaggatctgaatccagtttggccctgaggctggtgaatggaggtgacaggtgtcagggccgagtggaggtcctataccgaggcccctggggcaccgtgtgtgatgactactgggacaccaatgatgccaatgtggtttgcaggcagctgggctgtggctgggccacgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctcgcatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccacgtcagccccaggaagtgcccggtttggccagggttcaggacccattgccctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctctcgtgcatcaacagcaggatctgaatccactttggccctgagactggtgaatggaggtgacaggtgtcgaggccgagtggaggtcctataccaaggctcctggggcaccgtgtgtgatgactactgggacaccaatgatgccaacgtggtctgcaggcagctgggctgtggctgggccatgtcagccccaggaaatgcccagtttggccagggctcaggacccattgtcctggatgatgtgcgctgctcaggacacgagtcttacctgtggagctgcccccacaatggctggctctcccacaactgtggccatcatgaagatgctggtgtcatctgctcagctgctcagtcccagtcaacgcccaggccagatacttggctgaccaccaacttaccggcattgacagtaggatctgaatccagtttggctctgaggctggtgaatggaggtgacaggtgtcgaggccgagtggaggtcctgtatcgaggctcctggggaaccgtgtgtgatgacagctgggacaccaatgatgccaatgtggtctgcaggcagctgggctgtggctgggccatgtcggccccaggaaatgcccggtttggccagggctcaggacccattgtcctggatgatgtgcgctgctcagggaatgagtcctacctgtggagctgcccccacaaaggctggctcacccacaactgtggccatcacgaagacgctggtgtcatctgctcagccacccaaataaattctactacgacagattggtggcatccaacaactacaaccactgcaagaccctcttcaaattgtggtggcttcttattctatgccagtgggacattctccagcccatcctaccctgcatactaccccaacaatgctaagtgtgtttgggaaatagaagtgaattctggttatcgcataaacctgggcttcagtaatctgaaattggaggcacaccataactgcagttttgattatgttgaaatctttgatggatcattgaatagcagtctcctgctggggaaaatctgtaatgataccaggcaaatatttacatcttcttacaaccgaatgaccattcactttcgaagtgacatcagtttccaaaacactggctttttggcttggtataactccttcccaagcgatgccaccttgaggttggtcaatttaaattcatcctatggtctatgtgccgggcgtgtagaaatttaccatggtggcacctgggggacagtttgtgatgactcctggaccattcaggaagctgaggtggtctgcagacagctagggtgtggacgtgcagtttcagcccttggaaatgcatattttggctctggctctggccccatcaccctggacgatgtagagtgctcagggacggaatccactctctggcagtgccggaaccgaggctggttctcccacaactgtaatcatcgtgaagatgctggtgtcatctgctcaggaaaccatctatcgacacctgctccttttctcaacatcacccgtccaaacacagattattcctgcggaggcttcctatcccaaccatcaggggacttttccagcccattctatcccgggaactatccaaacaatgccaagtgtgtgtgggacattgaggtgcaaaacaactaccgtgtgactgtgatcttcagagatgtccagcttgaaggtggctgcaactatgattatattgaagttttcgatggcccctaccgcagttcccctctcattgctcgagtttgtgatggggccagaggctccttcacttcttcctccaacttcatgtccattcgcttcatcagtgaccacagcatcacaaggagagggttccgggctgagtactactccagtccctccaatgacagcaccaacctgctctgtctgccaaatcacatgcaagccagtgtgagcaggagctatctccaatccttgggcttttctgccagtgaccttgtcatttccacctggaatggatactacgagtgtcggccccagataacgccgaacctggtgatattcacaattccctactcaggctgcggcaccttcaagcaggcagacaatgacaccatcgactattccaacttcctcacagcagctgtctcaggtggcatcatcaagaggaggacagacctccgtattcacgtcagctgcagaatgcttcagaacacctgggtcgacaccatgtacattgctaatgacaccatccacgttgctaataacaccatccaggtcgaggaagtccagtatggcaattttgacgtgaacatttccttttatacttcctcatctttcttgtatcctgtgaccagccgcccttactacgtggacctgaaccaggacttgtacgttcaggctgaaatcctccattctgatgctgtactgaccttgtttgtggacacctgcgtggcatcaccatactccaatgacttcacgtctttgacttatgatctaatccggagtggatgcgtgagggatgacacctacggaccctactcctcgccatctcttcgcattgcccgcttccggttcagggccttccacttcctgaaccgcttcccctccgtgtacctgcgttgtaaaatggtggtgtgcagagcgtatgacccctcttcccgctgctaccgaggctgtgtgttgaggtcgaagagggatgtgggctcctaccaggaaaaggtggacgtcgtcctgggtcccatccagctgcagacccccccacgccgagaagaggagcctcggtaggtggtcgctctcagaccccactgtccaccggggcgcagacccctgactcggggacttgggatgttcctcttggtgtcatattccaactcagattgagccctacattgtgctgcacctggtcatacggagttgaatcagacctggttcccgcctcccccaaggctcatggtccttggaggacccgttgcagggtgaggtcaagagagttctgacctggatggcccatagacctgacgtcccagaatccatgcttctcatctgcaaaatgaaaatgtcaatacttacttcttagcactgttgagagggttacttacataaaggaattttggtgaaactgc

SEQ ID NO: 1083 - DNA, 5428 bp, Homo sapiens
tttatagcagcagcagaaatataccaccctagaggacacacctccttttagctaggtacctataaatgtccaggattttctattcaattgagaagaacccagcaaaatggggatctccacagtcatccttgaaatgtgtcttttatggggacaagttctatctacaggtgggtggatcccaaggactacagactacgcttcactgattccctcggaggtgcccttggatacaactgtagcagaaggttctccatttccctcggagttgaccctggagtcaactgtagcagaaggttctccgatttccttggagtcaaccctggagtcaactgtagcagaaggttctctgattccctcagagtcaaccctggagtcaactgtagcagaaggatctgattctggtttggccctgaggctggtgaatggagatggcaggtgtcagggccgagtggagatcctataccgaggctcctggggcaccgtgtgtgatgacagctgggacaccaatgatgccaacgtggtctgtaggcagctgggttgtggctgggccatgtcagctccaggaaatgcctggtttggccagggctcaggacccattgccctggatgatgtgcgctgctcaggacacgaatcctacctgtggagctgcccccacaatggctggctctcccataactgtggccatggtgaagatgctggtgttatctgctcagctgcccagcctcagtcaacactcaggccagaaagttggcctgtcaggatatcaccacctgtacccacagaaggatctgaatccagtttggccctgaggctggtgaatggaggcgacaggtgtcgaggccgagtggaggtcctataccgaggctcctggggcaccgtgtgtgatgactactgggacaccaatgatgccaatgtggtctgcaggcagctgggctgtggctgggccatgtcagccccaggaaatgcccagtttggccagggctcaggacccattgtcctggatgatgtgcgctgctcaggacacgagtcctacctgtggagctgcccccacaatggctggctcacccacaactgtggccatagtgaagacgctggtgtcatctgctcagctccccagtcccggccgacacccagcccagatacttggccgacctcacatgcatcaacagcaggatctgaatccagtttggccctgaggctggtgaatggaggtgacaggtgtcagggccgagtggaggtcctataccgaggctcctggggcaccgtgtgtgatgatagctgggacaccagtgacgccaatgtggtctgccggcagctgggctgtggctgggccacgtcagccccaggaaatgcccggtttggccagggttcaggacccattgtcctggatgacgtgcgctgctcaggctatgagtcctacctgtggagctgcccccacaatggctggctctcccataactgtcagcacagtgaagacgctggtgtcatctgctcagctgcccactcctggtcgacgcccagtccagacacattgccgaccatcaccttgcctgcatcgacagtaggatctgaatccagtttggccctgaggctggtgaatggaggtgacaggtgtcagggccgagtggaggtcctataccaaggctcctggggcaccgtgtgcgatgacagctgggacaccaatgatgccaatgtcgtctgcaggcaactgggctgtggctgggccatgtcagccccaggaaatgcccggtttggtcagggctcaggacccattgtcctggatgatgtgcgctgctcaggacacgagtcttacctgtggagctgcccccacaatggctggctctcccacaactgtggccatagtgaagacgctggtgtcatctgctcagcttcccagtcccggccaacacctagtccagacacttggccaacctcacatgcatcaacagcaggaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccacgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctctcgtgcatcaacagcaggatctgaatccactttggccctgagactggtgaatggaggtgacaggtgtcgaggccgagtggaggtcctataccaaggctcctggggcaccgtgtgtgatgactactgggacaccaatgatgccaacgtggtctgcaggcagctgggctgtggctgggccatgtcagccccaggaaatgcccagtttggccagggctcaggacccattgtcctggatgatgtgcgctgctcaggacacgagtcttacctgtggagctgcccccacaatggctggctctcccacaactgtggccatcatgaagatgctggtgtcatctgctcagctgctcagtcccagtcaacgcccaggccagatacttggctgaccaccaacttaccggcattgacagtaggatctgaatccagtttggctctgaggctggtgaatggaggtgacaggtgtcgaggccgagtggaggtcctgtatcgaggctcctggggaaccgtgtgtgatgacagctgggacaccaatgatgccaatgtggtctgcaggcagctgggctgtggctgggccatgtcggccccaggaaatgcccggtttggccagggctcaggacccattgtcctggatgatgtgcgctgctcagggaatgagtcctacctgtggagctgcccccacaaaggctggctcacccacaactgtggccatcacgaagacgctggtgtcatctgctcagccacccaaataaattctactacgacagattggtggcatccaacaactacaaccactgcaagaccctcttcaaattgtggtggcttcttattctatgccagtgggacattctccagcccatcctaccctgcatactaccccaacaatgctaagtgtgtttgggaaatagaagtgaattctggttatcgcataaacctgggcttcagtaatctgaaattggaggcacaccataactgcagttttgattatgttgaaatctttgatggatcattgaatagcagtctcctgctggggaaaatctgtaatgataccaggcaaatatttacatcttcttacaaccgaatgaccattcactttcgaagtgacatcagtttccaaaacactggctttttggcttggtataactccttcccaagcgatgccaccttgaggttggtcaatttaaattcatcctatggtctatgtgccgggcgtgtagaaatttaccatggtggcacctgggggacagtttgtgatgactcctggaccattcaggaagctgaggtggtctgcagacagctagggtgtggacgtgcagtttcagcccttggaaatgcatattttggctctggctctggccccatcaccctggacgatgtagagtgctcagggacggaatccactctctggcagtgccggaaccgaggctggttctcccacaactgtaatcatcgtgaagatgctggtgtcatctgctcaggaaaccatctatcgacacctgctccttttctcaacatcacccgtccaaacacagattattcctgcggaggcttcctatcccaaccatcaggggacttttccagcccattctatcccgggaactatccaaacaatgccaagtgtgtgtgggacattgaggtgcaaaacaactaccgtgtgactgtgatcttcagagatgtccagcttgaaggtggctgcaactatgattatattgaagttttcgatggcccctaccgcagttcccctctcattgctcgagtttgtgatggggccagaggctccttcacttcttcctccaacttcatgtccattcgcttcatcagtgaccacagcatcacaaggagagggttccgggctgagtactactccagtccctccaatgacagcaccaacctgctctgtctgccaaatcacatgcaagccagtgtgagcaggagctatctccaatccttgggcttttctgccagtgaccttgtcatttccacctggaatggatactacgagtgtcggccccagataacgccgaacctggtgatattcacaattccctactcaggctgcggcaccttcaagcaggcagacaatgacaccatcgactattccaacttcctcacagcagctgtctcaggtggcatcatcaagaggaggacagacctccgtattcacgtcagctgcagaatgcttcagaacacctgggtcgacaccatgtacattgctaatgacaccatccacgttgctaataacaccatccaggtcgaggaagtccagtatggcaattttgacgtgaacatttccttttatacttcctcatctttcttgtatcctgtgaccagccgcccttactacgtggacctgaaccaggacttgtacgttcaggctgaaatcctccattctgatgctgtactgaccttgtttgtggacacctgcgtggcatcaccatactccaatgacttcacgtctttgacttatgatctaatccggagtggatgcgtgagggatgacacctacggaccctactcctcgccatctcttcgcattgcccgcttccggttcagggccttccacttcctgaaccgcttcccctccgtgtacctgcgttgtaaaatggtggtgtgcagagcgtatgacccctcttcccgctgctaccgaggctgtgtgttgaggtcgaagagggatgtgggctcctaccaggaaaaggtggacgtcgtcctgggtcccatccagctgcagacccccccacgccgagaagaggagcctcggtaggtggtcgctctcagaccccactgtccaccggggcgcagacccctgactcggggacttgggatgttcctcttggtgtcatattccaactcagattgagccctacattgtgctgcacctggtcatacggagttgaatcagacctggttcccgcctcccccaaggctcatggtccttggaggacccgttgcagggcgaggtcaagagagttctgacctggatggcccatagacctgacgtcccagaatccatgcttctcatctgcaaaatgaaaatgtcaatacttacttcttagcactgttgagagggttacttacataaaggaattttggtgaaactgcctcagcctgt

SEQ ID NO: 1084 - DNA, 7686 bp, Homo sapiens
tttatagcagcagcagaaatataccaccctagaggacacacctccttttagctaggtacctataaatgtccaggattttctattcaattgagaagaacccagcaaaatggggatctccacagtcatccttgaaatgtgtcttttatggggacaagttctatctacaggtgggtggatcccaaggactacagactacgcttcactgattccctcggaggtgcccttggatcaaactgtagcagaaggttctccatttccctcggagtcgaccctggagtcaactgcagcagaaggttctccgatttccttggagtcaaccctggagtcaactgtagcagaaggttctctgattccctcagagtcaaccctggagtcaactgtagcagaaggatctgattctggtttggccctgaggctggtgaatggagatggcaggtgtcagggccgagtggagatcctataccgaggctcctggggcaccgtgtgtgatgacagctgggacaccaatgatgccaacgtggtctgtaggcagctgggttgtggctgggccatgtcagctccaggaaatgcctggtttggccagggctcaggacccattgccctggatgatgtgcgctgctcaggacacgaatcctacctgtggagctgcccccacaatggctggctctcccataactgtggccatggtgaagatgctggtgttatctgctcagctgcccagcctcagtcaacactcaggccagaaagttggcctgtcaggatatcaccacctgtacccacagaaggatctgaatccagtttggccctgaggctggtgaatggaggcgacaggtgtcgaggccgagtggaggtcctataccgaggctcctggggcaccgtgtgtgatgactactgggacaccaatgatgccaatgtggtctgcaggcagctgggctgtggctgggccatgtcagccccaggaaatgcccagtttggccagggctcaggacccattgtcctggatgatgtgcgctgctcaggacacgagtcctacctgtggagctgcccccacaatggctggctcacccacaactgtggccatagtgaagacgctggtgtcatctgctcagctccccagtcccggccgacacccagcccagatacttggccgacctcacatgcatcaacagcaggacctgaatccagtttggccctgaggctggtgaatggaggtgacaggtgtcagggccgagtggaggtcctataccgaggctcctggggcaccgtgtgtgatgatagctgggacaccagtgacgccaatgtggtctgccggcagctgggctgtggctgggccacgtcagccccaggaaatgcccggtttggccagggttcaggacccattgtcctggatgacgtgcgctgctcaggctatgagtcctacctgtggagctgcccccacaatggctggctctcccataactgtcagcacagtgaagacgctggtgtcatctgctcagctgcccactcctggtcgacgcccagtccagacacgttgccgaccatcaccttacctgcatcgacagtaggatctgaatccagtttggccctgaggctggtgaatggaggtgacaggtgtcagggccgagtggaggtcctataccgaggctcctggggcaccgtgtgtgatgacagctgggacaccaatgatgccaatgtggtctgcaggcagctgggctgtggctgggccatgttggccccaggaaatgcccggtttggtcagggctcaggacccattgtcctggatgacgtgcgctgctcagggaatgagtcctacttgtggagctgcccccacaatggctggctctcccataactgtggccatagtgaagacgctggtgtcatctgctcaggacctgaatccagtttggccctgaggctggtgaatggaggtgacaggtgtcagggccgagtggaggtcctataccgaggctcttggggcaccgtgtgtgatgacagctgggacaccaatgatgccaatgtggtctgcaggcagctgggctgtggctgggccatgtcagccccaggaaatgcccggtttggtcagggctcaggacccattgtcctggatgatgtgcgctgctcaggacatgagtcctacctgtggagctgccccaacaatggctggctctcccacaactgtggccatcatgaagatgctggtgtcatctgctcagctgcccagtcccggtcgacgcccaggccagacacgttgtcgaccatcacgttacctccatcgacagtaggatctgaatccagtttgaccctgaggctggtgaatggaagtgacaggtgtcagggccgagtagaggtcctataccgaggctcctggggcaccgtgtgtgatgacagctgggataccaatgatgccaatgtggtctgcaggcagctgggctgtggctgggccatgtcagccccaggaaatgcccggtttggccagggctcaggacccattgttctggatgatgtgcgctgctcaggacacgagtcctacctgtggagctgcccccacaatggctggctctcccacaactgtggccatcatgaagatgctggtgtcatctgctcagtttcccagtcccggccgacacccagtccagatacttggccgacctcacatgcatcaacagcaggatctgaatccagtttggccctgaggctggtgaatggaggtgacaggtgtcagggccgagtggaggtcctataccgaggctcctggggcaccgtgtgtgatgatagctgggacaccagtgacgccaatgtggtctgccggcagctgggctgtggctgggccacgtcagccccaggaaatgcccggtttggccagggttcaggacccattgtcctggatgacgtgcgctgctcaggctatgagtcctacctgtggagctgcccccacaatggctggctctcccataactgtcagcacagtgaagacgctggtgtcatctgctcagctgcccactcctggtcgacgcccagtccagacacattgccgaccatcaccttgcctgcatcgacagtaggatctgaatccagtttggccctgaggctggtgaatggaggtgacaggtgtcagggccgagtggaggtcctataccaaggctcctggggcaccgtgtgcgatgacagctgggacaccaatgatgccaatgtcgtctgcaggcaaccgggctgtggctgggccatgtcagccccaggaaatgcccggtttggtcagggctcaggacccattgtcctggatgatgtgcgctgctcaggacacgagtcttacccgtggagctgcccccacaatggctggctctcccacaactgtggccatagtgaagacgctggtgtcatctgctcagcttcccagtcccggccaacacctagtccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccatgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccacgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccacgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctctcgtgcatcaacagcaggatctgaatccactttggccctgagactggtgaatggaggtgacaggtgtcgaggccgagtggaggtcctataccaaggctcctggggcaccgtgtgtgatgactactgggacaccaatgatgccaacgtggtctgcaggcagctgggctgtggctgggccatgtcagccccaggaaatgcccagtttggccagggctcaggacccattgtcctggatgatgtgcgctgctcaggacacgagtcttacctgtggagctgcccccacaatggctggctctcccacaactgtggccatcatgaagatgctggtgtcatctgctcagctgctcagtcccagtcaacgcccaggccagatacttggctgaccaccaacttaccggcattgacagtaggatctgaatccagtttggctctgaggctggtgaatggaggtgacaggtgtcgaggccgagtggaggtcctgtatcgaggctcctggggaaccgtgtgtgatgacagctgggacaccaatgatgccaatgtggtctgcaggcagctgggctgtggctgggccatgtcggccccaggaaatgcccggtttggccagggctcaggacccattgtcctggatgatgtgcgctgctcagggaatgagtcctacctgtggagctgcccccacaaaggctggctcacccacaactgtggccatcacgaagacgctggtgtcatctgctcagccacccaaataaattctactacgacagattggtggcatccaacaactacaaccactgcaagaccctcttcaaattgtggtggcttcttattctatgccagtgggacattctccagcccatcctaccctgcatactaccccaacaatgctaagtgtgtttgggaaatagaagtgaattctggttatcgcataaacctgggcttcagtaatctgaaattggaggcacaccataactgcagttttgattatgttgaaatctttgatggatcattgaatagcagtctcctgctggggaaaatctgtaatgataccaggcaaatatttacatcttcttacaaccgaatgaccattcactttcgaagtgacatcagtttccaaaacactggctttttggcttggtataactccttcccaagcgatgccaccttgaggttggtcaatttaaattcatcctatggtctatgtgccgggcgtgtagaaatttaccatggtggcacctgggggacagtttgtgatgactcctggaccattcaggaagctgaggtggtctgcagacagctagggtgtggacgtgcagtttcagcccttggaaatgcatattttggctctggctctggccccatcaccctggacgatgtagagtgctcagggacggaatccactctctggcagtgccggaaccgaggctggttctcccacaactgtaatcatcgtgaagatgctggtgtcatctgctcaggaaaccatctatcgacacctgctccttttctcaacatcacccgtccaaacacagattattcctgcggaggcttcctatcccaaccatcaggggacttttccagcccattctatcccgggaactatccaaacaatgccaagtgtgtgtgggacattgaggtgcaaaacaactaccgtgtgactgtgatcttcagagatgtccagcttgaaggtggctgcaactatgattatattgaagttttcgatggcccctaccgcagttcccctctcattgctcgagtttgtgatggggccagaggctccttcacttcttcctccaacttcatgtccattcgcttcatcagtgaccacagcatcacaaggagagggttccgggctgagtactactccagtccctccaatgacagcaccaacctgctctgtctgccaaatcacatgcaagccagtgtgagcaggagctatctccaatccttgggcttttctgccagtgaccttgtcatttccacctggaatggatactacgagtgtcggccccagataacgccgaacctggtgatattcacaattccctactcaggctgcggcaccttcaagcaggcagacaatgacaccatcgactattccaacttcctcacagcagctgtctcaggtggcatcatcaagaggaggacagacctccgtattcacgtcagctgcagaatgcttcagaacacctgggtcgacaccatgtacattgctaatgacaccatccacgttgctaataacaccatccaggtcgaggaagtccagtatggcaattttgacgtgaacatttccttttatacttcctcatctttcttgtatcctgtgaccagccgcccttactacgtggacctgaaccaggacttgtacgttcaggctgaaatcctccattctgatgctgtactgaccttgtttgtggacacctgcgtggcatcaccatactccaatgacttcacgtctttgacttatgatctaatccggagtggatgcgtgagggatgacacctacggaccctactcctcgccgtctcttcgcattgcccgcttccggttcagggccttccacttcctgaaccgcttcccctccgtgtacctgcgttgtaaaatggtggtgtgcagagcgtatgacccctcttcccgctgctaccgaggctgtgtgttgaggtcgaagagggatgtgggctcctaccaggaaaaggtggacgtcgtcctgggtcccatccagctgcagacccccccacgccgagaagaggagcctcggtaggtggtcgctctcagaccccactgtccaccggggcgcagacccctgactcggggacttgggatgttcctcttggtgtcatattccaactcagattgagccctacattgtgctgcacctggtcatacggagttgaatcagacctggttcccgcctcccccaaggctcatggtccttggaggacccgttgcagggcgaggtcaagagagttctgacctggatggcccatagacctgacgtcccagaatccatgcttctcatctgcaaaatgaaaatgtcaatacttacttcttagcactgttgagagggttacttacataaaggaattttggtgaaactgc

SEQ ID NO: 1085 - DNA, 5474 bp, Homo sapiens
tttatagcagcagcagaaatataccaccctagaggacacacctccttttagctaggtacctataaatgtccaggattttctattcaattgagaagaacccagcaaaatggggatctccacagtcatccttgaaatgtgtcttttatggggacaagttctatctacaggtgggtggatcccaaggactacagactacgcttcactgattccctcggaggtgcccttggatacaactgtagcagaaggttctccatttccctcggagttgaccctggagtcaactgtagcagaaggttctccgatttccttggagtcaaccctggagtcaactgtagcagaaggttctctgattccctcagagtcaaccctggagtcaactgtagcagaaggatctgattctggtttggccctgaggctggtgaatggagatggcaggtgtcagggccgagtggagatcctataccgaggctcctggggcaccgtgtgtgatgacagctgggacaccaatgatgccaacgtggtctgtaggcagctgggttgtggctgggccatgtcagctccaggaaatgcctggtttggccagggctcaggacccattgccctggatgatgtgcgctgctcaggacacgaatcctacctgtggagctgcccccacaatggctggctctcccataactgtggccatggtgaagatgctggtgttatctgctcagctgcccagcctcagtcaacactcaggccagaaagttggcctgtcaggatatcaccacctgtacccacagaaggatctgaatccagtttggccctgaggctggtgaatggaggcgacaggtgtcgaggccgagtggaggtcctataccgaggctcctggggcaccgtgtgtgatgactactgggacaccaatgatgccaatgtggtctgcaggcagctgggctgtggctgggccatgtcagccccaggaaatgcccagtttggccagggctcaggacccattgtcctggatgatgtgcgctgctcaggacacgagtcctacctgtggagctgcccccacaatggctggctcacccacaactgtggccatagtgaagacgctggtgtcatctgctcagctccccagtcccggccgacacccagcccagatacttggccgacctcacatgcatcaacagcaggatctgaatccagtttggccctgaggctggtgaatggaggtgacaggtgtcagggccgagtggaggtcctataccgaggctcctggggcaccgtgtgtgatgatagctgggacaccagtgacgccaatgtggtctgccggcagctgggctgtggctgggccacgtcagccccaggaaatgcccggtttggccagggttcaggacccattgtcctggatgacgtgcgctgctcaggctatgagtcctacctgtggagctgcccccacaatggctggctctcccataactgtcagcacagtgaagacgctggtgtcatctgctcagctgcccactcctggtcgacgcccagtccagacacattgccgaccatcaccttgcctgcatcgacagtaggatctgaatccagtttggccctgaggctggtgaatggaggtgacaggtgtcagggccgagtggaggtcctataccaaggctcctggggcaccgtgtgcgatgacagctgggacaccaatgatgccaatgtcgtctgcaggcaactgggctgtggctgggccatgtcagccccaggaaatgcccggtttggtcagggctcaggacccattgtcctggatgatgtgcgctgctcaggacacgagtcttacctgtggagctgcccccacaatggctggctctcccacaactgtggccatagtgaagacgctggtgtcatctgctcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccacgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcaggatctgaatccactttggccctgagactggtgaatggaggtgacaggtgtcgaggccgagtggaggtcctataccaaggctcctggggcaccgtgtgtgatgactactgggacaccaatgatgccaacgtggtctgcaggcagctgggctgtggctgggccatgtcagccccaggaaatgcccagtttggccagggctcaggacccattgtcctggatgatgtgcgctgctcaggacacgagtcttacctgtggagctgcccccacaatggctggctctcccacaactgtggccatcatgaagatgctggtgtcatctgctcagctgctcagtcccagtcaacgcccaggccagatacttggctgaccaccaacttaccggcattgacagtaggatctgaatccagtttggctctgaggctggtgaatggaggtgacaggtgtcgaggccgagtggaggtcctgtatcgaggctcctggggaaccgtgtgtgatgacagctgggacaccaatgatgccaatgtggtctgcaggcagctgggctgtggctgggccatgtcggccccaggaaatgcccggtttggccagggctcaggacccattgtcctggatgatgtgcgctgctcagggaatgagtcctacctgtggagctgcccccacaaaggctggctcacccacaactgtggccatcacgaagacgctggtgtcatctgctcagaatccaattctggtttggccctgaggctggtgaatggaggtgaccagtgtcagggccaggtggaggtcctgtaccaagtctcctggggcaccgtgtatgatgacaccaatgacgccaatgtggtctgcaggcagctgggccgtggctgggccgtggcattcccaggaaatgcctgccacccaaataaattctactacgacagattggtggcatccaacaactacaaccactgcaagaccctcttcaaattgtggtggcttcttattctatgccagtgggacattctccagcccatcctaccctgcatactaccccaacaatgctaagtgtgtttgggaaatagaagtgaattctggttatcgcataaacctgggcttcagtaatctgaaattggaggcacaccataactgcagttttgattatgttgaaatctttgatggatcattgaatagcagtctcctgctggggaaaatctgtaatgataccaggcaaatatttacatcttcttacaaccgaatgaccattcactttcgaagtgacatcagtttccaaaacactggctttttggcttggtataactccttcccaagcgatgccaccttgaggttggtcaatttaaattcatcctatggtctatgtgccgggcgtgtagaaatttaccatggtggcacctgggggacagtttgtgatgactcctggaccattcaggaagctgaggtggtctgcagacagctagggtgtggacgtgcagtttcagcccttggaaatgcatattttggctctggctctggccccatcaccctggacgatgtagagtgctcagggacggaatccactctctggcagtgccggaaccgaggctggttctcccacaactgtaatcatcgtgaagatgctggtgtcatctgctcaggaaaccatctatcgacacctgctccttttctcaacatcacccgtccaaacacagattattcctgcggaggcttcctatcccaaccatcaggggacttttccagcccattctatcccgggaactatccaaacaatgccaagtgtgtgtgggacattgaggtgcaaaacaactaccgtgtgactgtgatcttcagagatgtccagcttgaaggtggctgcaactatgattatattgaagttttcgatggcccctaccgcagttcccctctcattgctcgagtttgtgatggggccagaggctccttcacttcttcctccaacttcatgtccattcgcttcatcagtgaccacagcatcacaaggagagggttccgggctgagtactactccagtccctccaatgacagcaccaacctgctctgtctgccaaatcacatgcaagccagtgtgagcaggagctatctccaatccttgggcttttctgccagtgaccttgtcatttccacctggaatggatactacgagtgtcggccccagataacgccgaacctggtgatattcacaattccctactcaggctgcggcaccttcaagcaggcagacaatgacaccatcgactattccaacttcctcacagcagctgtctcaggtggcatcatcaagaggaggacagacctccgtattcacgtcagctgcagaatgcttcagaacacctgggtcgacaccatgtacattgctaatgacaccatccacgttgctaataacaccatccaggtcgaggaagtccagtatggcaattttgacgtgaacatttccttttatacttcctcatctttcttgtatcctgtgaccagccgcccttactacgtggacctgaaccaggacttgtacgttcaggctgaaatcctccattctgatgctgtactgaccttgtttgtggacacctgcgtggcatcaccatactccaatgacttcacgtctttgacttatgatctaatccggagtggatgcgtgagggatgacacctacggaccctactcctcgccatctcttcgcattgcccgcttccggttcagggccttccacttcctgaaccgcttcccctccgtgtacctgcgttgtaaaatggtggtgtgcagagcgtatgacccctcttcccgctgctaccgaggctgtgtgttgaggtcgaagagggatgtgggctcctaccaggaaaaggtggacgtcgtcctgggtcccatccagctgcagacccccccacgccgagaagaggagcctcggtaggtggtcgctctcagaccccactgtccaccggggcgcagacccctgactcggggacttgggatgttcctcttggtgtcatattccaactcagattgagccctacattgtgctgcacctggtcatacggagttgaatcagacctggttcccgcctcccccaaggctcatggtccttggaggacccgttgcagggcgaggtcaagagagttctgacctggatggcccatagacctgacgtcccagaatccatgcttctcatctgcaaaatgaaaatgtcaatacttacttcttagcactgttgagagggttacttacataaaggaattttggtgaaactgcctcagcctgt

SEQ ID NO: 1086 - DNA, 3404 bp, Homo sapiens
tttctttggagaacacatctatgaaatagtaaaaggagacacacgagccatcggaatcatcagactttggaatgggcaagaacagaatggttcttcttggaggtgctgggtctcccggttataaaggatttgtccacctaggtttctttgttgtggctgtgagctcacttctcagcgtctctgctgtcactcaggctcctgaaggaaggaagaaggaactgagactggccggcggtgaaaacaactgtagtgggagagtggagctcaagatccacgagaagtggggcacagtgtgcggtaacggctggagcatgaacgaggtgtccgtggtttgccagcagctaggatgcccaactttgattaaagccccgggatgggctaacgccagcgcgggctctggggacatctggatggacaaggtttcttgcacagggaatgagtcagctctttgggactgcaaacatgaggggtggggaaagcacaactgtacccatgaacaagatgctggagtgacctgcgcagatggatctaatttggagatgagactggtgaacagcggggacaaccgatgctcaggaagagtagaaataaagttccagggaaagtgggggacagtgtgtgacgacaacttcagcaaagatcacgcttctgtgatttgtaaacaacttggatgtggaagtgccatcagtttctctggctcagctaaattaggagctggttctggacaaatctggcttgatgatctggcatgcaatggaaatgagtcagctatctgggactgcaaacaccggggatggggaaggcacaactgtgaccatgctgaggacgtcggtgtgatctgcttagacggagcggatctgagcctgagactggtggatggggtgtccaaatgttcaggaagattggaagtgagattccaaggagagtgggggaccgtgtgtgacgacagctgggatcgccgtgacgcttctgtggtgtgtaagcaactgggatgtccaactgccatcactgccattggccgagttaatgccagtgagggatccggaccaatttggcttgacagtatctcctgcgagggacatgagccggctctttgggagtgtaagcaccaggaatgggggaagcattactgtaaccacaaagaagacgctggcgtgacatgttctgatggagcagatctggaacttcgactcgtcggtggaggcagtcgctgtgctgggatggtggaggtggagattcagaagctgactgggaaggtgtgcagccgaggctggacactgacagatgccgacgtggtttgcagacagcttggatgtggctctgcacttcaaacacagtctaagatctactctaaaaccaaaactgaggcaacaaatacgtggctctttcctggctcttgcagtggaaatgaaacttctctttggcaatgtaaaaactggcagtggggcggcctttcctgtgatcatttcgaagaagcccaagttacttgctcaggccacaggaaacccagactggttggaggagaaatcccatgttccggtcgtgtggaagtgaaacacggagacacgtggggttccgtctgtgatttcgacttgtctctggaagctgccggcgtggtgtgcagggaattacaatgtggaacagtcgtctctatcctagggggagcacattttggagaaggaagcggacagatctggggtgaagaattccagtgtagtggagatgagtcccatctttctctgtgctcggtggcgcccccactggacagaacttgtagccacagcagggatgtcagcatagtctgctcacgatacatagatatccgtctggcagatggcaagtcctcctgtgagggaagagtggagctcaagacactcggagcctggggtcccctctgcagctctcactgggacatagaagatgctcatgtcttatgtcagcagcttaagtgtggagttgccctttctactccaggaggagcacattttgggaaaggagccggtcaggtctggaggcacaagttccactgcactggaactgaggagcatataggggattgccctatgactgctctgggtacaccgatgtgttctgacggacaggtagcctctgtaatttgctcaggaaaccaatcgcatacactgttgccatgtagttcatcatcttcggtccaaacaacaagttctaccattgcaaaggacagtgacgttccctgcatagcaagtggtcaactccgcttggtaggtggaggtggtcgctgcgctgggagagtagaggtctaccatgagggctcttggggcaccatctgtgatgacagctgggatctgacggatgccaatgtggtgtgcaagcagctggactgtggcgtggctattaatgccactggttctgcctactttggggaagggacaggagatatctggctagacgaaattgactgcagtggaaaagagtctcatatctggcagtgccattcacatggctggggacgccataactgcaggcacaaggaagatgcaggtgttgtctgctcggagttcatgtctctgaggctgaccaatgaagcccacagagtgaactgtacaggccgtctggaagtgttttacaatggtacatggggcagtattggcagcagcaatatgtctccaaccactgtgggggtggtgtgccgtcagctgggctgtgcagacaatggaacagtgaaacctacatcttcagacaagacaccaaccaggcccatgtggacagatagtgtgcagtgtccaaaaggagttgacactttgtggcagtgcccctcatcaccttggaaacagagacaagccagcccctcccaggagtcctggattgtctgtgacgacaaaataagactacaggaagggcatacagactgttctggacgtgtggagatctggcatagaggttcctggggaacagtgtgtgatgactcctgggatcttaatgatgctgaggttgcatgtaagcagctgggctgtggtcaagctgtggaggcactaaaagaagcagcatttggtccaggaactgggcccatatggctgaatgaaatgaagtgtagagggaatgagtcttccctgtgggattgtcctgccagaccatggagtcacagcgactgcgggcacaaagaagatgcttctgtgaagtgcctcccaagaatgactttagaatcacagcatggcacaggtcattcaaccctcactgcactcctggtttgtggagccattctattggtccttctcattgccttcctcttgtggactctgaagcgacgacagacccaacggcttacagtttcctcaagaggagaggtcttgatacatcaagttcagtaccaagagatggattcgaagacggatgatctggacttgctgaaatcctcgggtcagtga

SEQ ID NO: 1087 - DNA, 1182 bp, Homo sapiens
tagttctccctgagtgagacttgcctgcttctctggcccctggtcctgtcctgttctccagcatggtgtgtctgaagctccctggaggctcctgcatgacagcgctgacagtgacactgatggtgctgagctccccactggctttggctggggacacccgaccacgtttcttgtggcagcttaagtttgaatgtcatttcttcaatgggacggagcgggtgcggttgctggaaagatgcatctataaccaagaggagtccgtgcgcttcgacagcgacgtgggggagtaccgggcggtgacggagctggggcggcctgatgccgagtactggaacagccagaaggacctcctggagcagaggcgggccgcggtggacacctactgcagacacaactacggggttggtgagagcttcacagtgcagcggcgagttgagcctaaggtgactgtgtatccttcaaagacccagcccctgcagcaccacaacctcctggtctgctctgtgagtggtttctatccaggcagcattgaagtcaggtggttccggaacggccaggaagagaaggctggggtggtgtccacaggcctgatccagaatggagattggaccttccagaccctggtgatgctggaaacagttcctcggagtggagaggtttacacctgccaagtggagcacccaagtgtgacgagccctctcacagtggaatggagagcacggtctgaatctgcacagagcaagatgctgagtggagtcgggggcttcgtgctgggcctgctcttccttggggccgggctgttcatctacttcaggaatcagaaaggacactctggacttcagccaacaggattcctgagctgaaatgcagatgaccacattcaaggaagaaccttctgtcccagctttgcagaatgaaaagctttcctgcttggcagttattcttccacaagagagggctttctcaggacctggttgctactggttcggcaactgcagaaaatgtcctcccttgtggcttcctcagctcctgcccttggcctgaagtcccagcattgatgacagcgcctcatcttcaacttttgtgctcccctttgcctaaaccgtatggcctcccgtgcatctgtactcaccctgtacgacaaacacattacattattaaatgtttctcaaagatggagtt

SEQ ID NO: 1088 - DNA, 1543 bp, Homo sapiens
ggaatgtgggtggaggggttcatagttctccctgagtgagacttgcctgctgctctggcccctggtcctgtcctgttctccagcatggtgtgtctgaggctccctggaggctcctgcatggcagttctgacagtgacactgatggtgctgagctccccactggctttggctggggacaccagaccacgtttcttggaggaggttaagtttgagtgtcatttcttcaatgggacggagcgggtgcggttgctggaaagatacttccataaccaggaggagaacgtgcgcttcgacagcgacgtgggggagttccgggcggtgacggagctggggcggcctgatgccgagtactggaacagccagaaggacctcctggagcagaggcgtgccgcggtggacacctactgcagacacaactacggggttggtgagagcttcacagtgcagcggcgagtccatcctaaggtgactgtgtatccttcaaagacccagcccctgcagcaccataacctcctggtctgttctgtgagtggtttctatccaggcagcattgaagtcaggtggttccggaatggccaggaagagaagactggggtggtgtccacaggcctgatccacaatggagactggaccttccagaccctggtgatgctggaaacagttcctcggagtggagaggtttacacctgccaagtggagcacccaagcgtgacaagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaagaggattcctgagctgaagtgcagatgacacattcaaagaagaactttctgccccagctttgcaggatgaaaagctttccctcctggctgttattcttccacaagagagggctttctcaggacctggttgctactggttcagcaactgcagaaaatgtcctcccttgtggcttcctcagctcctgttcttggcctgaagccccacagctttgatggcagtgcctcatcttcaacttttgtgctcccctttgcctaaaccctatggcctcctgtgcatctgtactcaccctgtaccacaaacacattacattattaaatgtttctcaaagatggagttaaatatcatctggtccatttggctccaaagacaaaaaatgaaaagaaaagaaaaagggaaggaagattatttcccaatagaataatgattttcatgtatatgtcatgagtgtgtgaggtaatacatatgttaaatagcttgctttagacattccacactataggcatatatcaaaacttcatgctgtacaacatgaatatgctatacaatttttacttgtcaattaaaaaaatgctaatatttaaaaaggtaatacataaaaactgagaacagactgtaacaactgaaacaaactgggcaaacatgagatgagaaaccaaccagcaagtcaatcagaa

SEQ ID NO: 1089 - DNA, 1145 bp, Homo sapiens
ttttttttttttttttttttttgactgaactaagtggcttttttattagagaaagccagaattacaaaagacttcccttttcttggggtatggctgtctcagcacaatactcaacataactgcagaactgatgtggctcaggcaccctggttttaattccttgaggatctggcaattggcttacgcaaaaggtcaccatttgaggtcctgccttactaattatgtgctgcccaacaactaaatttgtaatttgtttttctctagtttgagcagggtctgaattttttcatttatttccttttttgccagcagacagacttgagtctgtaaagacaagcaaatacactgacagaagtttaccatagtttctaaaatgtaaaaaagaaaacccccaaaagactcaagaaaattagaccacaaattttgcattgttcattgtagcactattggtaataaaataacaaatgtttgtgcatttttatgtgaagatccttctcgtatttcatttggaaagatgagcaagaggtctgcttccttcattttacttccccttctgtttttgaaaggcagtttcgccaagcttaatgcaagaatatctgactgtttagaagaaagatattgccacaatctctggatggttttccagggttgtgttattactgagcttcatctttccagaatgagcaaaacactgtccagtctttgttacgattttgtaataaatgtgtacattttttttaaatttttggacatcacatgaataaaggtatgtatgtacgaatgtgtatatattatatatatgacatctattttggaaaatgtttgccctgctgtacctcatttttaggaggtgtgcatggatgcaatatatgaaaatgggacattctggaactgctggtcaggggactttgtcgccctgtgcactaaaagggccagattttcagcagccaaggacatccatacccaagtgaatgtgatgggacttaaaagaagtgaactgagacaattcactctggctgtttgaacagcagcgtttcataggaagagaaaaaaagatcaatcttgtattttctgaccacataaaggcttcttctctttgtaataaagtagaaaagctctcctcaaaaaaaaaaaaaaaaaaaaaa

SEQ ID NO: 1090 - DNA, 1097 bp, Homo sapiens
tggcccctggtcctgtcctgttctccagcatggtgtgtctgaggctccctggaggctcctgcatggcagttctgacagtgacactgatggtgctgagctccccactggctttggctggggacaccagaccacgtttcttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctgatgaggagtactggaacagccagaaggacttcctggaagacaggcgggccgcggtggacacctactgcagacacaactacggggttggtgagagcttcacagtgcagcggcgagtccatcctaaggtgactgtgtatccttcaaagacccagcccctgcagcaccacaacctcctggtctgttctgtgagtggtttctatccaggcagcattgaagtcaggtggttccggaatggccaggaagagaagactggggtggtgtccacaggcctgatccacaatggagactggaccttccagaccctggtgatgctggaaacagttcctcggagtggagaggtttacacctgccaagtggagcacccaagcgtgacaagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaagaggattcctgagctgaagtgcagatgacacattcaaagaagaactttctgccccagctttgcaggatgaaaagctttccctcctggctgttattcttccacaagagagggctttctcaggacctggttgctactggttcagcaactgcagaaaatgtcctcccttgtggcttcctcagctcctgttcttggcctgaagccccacagctttgatggcagcgcctcatcttcaacttttgtgctcccctttgcctaaaccctatggcctcctgtgcatctgtact

SEQ ID NO: 1091 - DNA, 547 bp, Homo sapiens
ccccagcacgtttcttggagcaggttaaacatgagtgtcatttcttcaacgggacggagcgggtgcggttcctggacagatacttctatcaccaagaggagtacgtgcgcttcgacagcgacgtgggggagtaccgggcggtgacggagctggggcggcctgatgccgagtactggaacagccagaaggacctcctggagcagaagcgggccgcggtggacacctactgcagacacaactacggggttggtgagagcttcacagtgcagcggcgagtctatcctgaggtgactgtgtatcctgcaaagacccagcccctgcagcaccacaacctcctggtctgctctgtgaatggtttctatccaggcagcattgaagtcaggtggttccggaacggccaggaagagaagactggggtggtgtccacaggcctgatccagaatggagactggaccttccagaccctggtgatgctggaaacagttcctcggagtggagaggtttacacctgccaagtggagcacccaagcctgacgagccctctcac

SEQ ID NO: 1092 - DNA, 942 bp, Homo sapiens
gcatggtgtgtctgaggctccctggaggctcctgcatggcagttctgacagtgacactgatggtgctgagctccccactggctttggctggggacaccagaccacgtttcttggaggaggttaagtttgagtgtcatttcttcaacgggacggagcgggtgcggttgctggaaagacgcgtccataaccaagaggagtacgcgcgctacgacagcgacgtgggggagtaccgggcggtgacggagctggggcggcctgatgccgagtactggaacagccagaaggacctcctggagcggaggcgtgccgcggtggacacctactgcagacacaactacggggttggtgagagcttcacagtgcagcggcgagttcaacctaaggtgactgtgtatccttcaaagacccagcccctgcagcaccacaacctcctggtctgttctgtgaatggtttctatccaggcagcattgaagtcaggtggttccggaacggccaggaagagaagactggggtggtgtccacgggcctgatccagaatgaagactggaccttccagaccctggtgatgctggaaacagttcctcagagtggagaggtttacacctgccaagtggagcacccaagtgtgatgagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttccgccaacaggattcctgagctgaagtgcagatgaccacattcaaggaagaacctactgccccagctttgcaggatgaaaagctttgctgcctggctgttattcttccgcaagagagggctttctcaggacctggttgctactggttcagcaactgcagaaaa

SEQ ID NO: 1093 - DNA, 1171 bp, Homo sapiens
ccagcatggtgtgtctgaagctccctggaggttcctacatggcaaagctgacagtgacactgatggtgctgagctccccactggctttggctggggacacccgaccacgtttcttgcagcaggataagtatgagtgtcatttcttcaacgggacggagcgggtgcggttcctgcacagagacatctataaccaagaggaggacttgcgcttcgacagcgacgtgggggagtaccgggcggtgacggagctggggcggcctgacgctgagtactggaacagccagaaggacttcctggaagacaggcgcgccgcggtggacacctactgcagacacaactacggggttggtgagagcttcacagtgcagcggcgagttgagcctaaggtgactgtgtatcctgcaaggacccagaccctgcagcaccacaacctcctggtctgctctgtgaatggtttctatccaggcagcattgaagtcaggtggttccggaacagccaggaagagaaggctggggtggtgtccacaggcctgattcagaatggagactggaccttccagaccctggtgatgctggaaacagttcctcgaagtggagaggtttacacctgccaagtggagcacccaagcgtgacgagccctctcacagtggaatggagagcacagtctgaatctgcacagagcaagatgctgagtggagtcgggggctttgtgctgggcctgctcttccttggggccgggctattcatctacttcaagaatcagaaagggcactctggacttcacccaacaggactcgtgagctgaagtgcagatgaccacattcaagggggaaccttctgccccagctttgcatgatgaaaagctttcctgcttggctcttattcttccacaagagaggactttctcaggccctggttgctaccggttcagcaactctgcagaaaatgtccatccttgtggcttcctcagctcctgcccttggcctgaagtcccagcattgatggcagtgcctcatcttcaactttagtgctcccctttacctaaccctacggcctcccatgcatctgtactccccctgtgtgccacaaatgcactacgttattaaatttttctgaagcccagagttaaaaatcatctgtccacctggctccaaagacaaaaaataaaaa

SEQ ID NO: 1094 - DNA, 514 bp, Homo sapiens
ccccagcacgtttcttggagcaggttaaacatgagtgtcatttcttcaacgggacggagcgggtgcggttcctggacagatacttctatcaccaagaggagtacgtgcgcttcgacagcgacgtgggggagtaccgggcggtgacggagctggggcggcctgatgccgagtactggaacagccagaaggacctcctggagcagaagcgggccgcggtggacacctactgcagacacaactacggggttggtgagagcttcacagtgcagcggcgagtctatcctgaggtgactgtgtatcctgcaaagacccagcccctgcagcaccacaacctcctggtctgctctgtgaatggtttctatccaggcagcattgaagtcaggtggttccggaacggccaggaagagaagactggggtggtgtccacaggcctgatccagaatggagaagttcctcggagtggagaggtttacacctgccaagtggagcacccaagcctgacgagccctctcac

SEQ ID NO: 1095 - DNA, 3429 bp, Homo sapiens
gagacaaagcagcgcccgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctggggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttagaagcagtccctggagaaggcatgttcccagaaaggtctctggagggacaaactcactcagtaaaacataatgtatcatcatgaagaaaactgattctctatgacatgaaatgaaaattttaatgcattgttataattactaatgtacgctgctgcaggacattaataaagttgcttttttaggctacagtgtctcgatgccat

SEQ ID NO: 1096 - DNA, 4675 bp, Homo sapiens
agactgccgattctgcatagagagatcatctaaatgggcagaagcctgcacaatttatgaagtgctgatttaacaccagcctatgcaaggctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcagatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctggggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagaaaaacctgacaacatagagtttgctaaggcagtaatttagactttaccttatttgtgattactgtagtgattgattgattactattaactacaaggtataatttactatcaccttatttaaattttatgaattaatttgaatgttttttacactaactaacttttcccaataaagtccactatgaaaccacgacatccaagaggccaaagtcgtcttctctgccttcaagtcatagatttgcccgcagtatctgtggtgctctgggccctcccggtgtccgtctcttccaggatggggatgcccgggagggaaactgtctgtggctctaggctgcacggctcgtgccaacccatcagggagggccatgcccgttgtcctattgagtgccccaccctgcacccccaccttgggaattcacatgtccattccttgaggttcatgtcaacctcggaggcatccctgtcttcattatagctgacccctctcctgcgtccttctgtcagcatatcccttctgcatccttcccgtcacacatacataccaagctatgatgattgattgatagtggccttcgagatgaaaaccatccttaaccccatgatccttcccagctggcatccccaccctaagcaaggttccctaaagagaagcttgttgtcattttctccccttcctcacttacagtcagctgtcaccttgctccctccacctcccctcgtcaaggtgactgccttccactgccagccacactggcaattgtcttgagacctcaccgtgcaagcggcctgggggcgtggcggggaggaggaggaggacaaggactcctgaacgctgctcactcggcttccaggacaccccgctcaggttctgcctgccttactgggggctcctcctcctttcctggggctgagaggttgtgtctgtgcccactctcctgagctcagccagaatctcgcatgtaaagacatccaaatgccgacttcttctccccagagcctggcttttataactgactgccgcctcacgctccattcggatgtctaatgaatctctcagacttgacctgtccaaactgcttgccacctctactcgccaccgcccacccccacaccctccataccgttttccccacgtcactgcccctcccccccttcctcttgccaaatgcctaaaaataaaaattctgaggtggatctgtagcacaatgggcttctagtgacaaatcaaaattctgatctttaaaatgtatgcacaatttacctgttaccgcctggcctaagccatcctgctgttactgctgtgtagcaagttgcagccaaagcgacctcacacggctcctgaaggtcaagaatctgggagcagctcagctggatggctgtgactcggggtctcatgaagtggccaagatgccagctaaggctgccgtctctgaaggcttgacctggcgaggatttgcttccagactcactcgcgtggctattgacagaaggcctcagttccatgccacatggcccgttccacagagcagctcacagcttggtagtagctggcttccccagagcggtatctgcgagcagcgtccagatggaagccatggtgttcccttaaaacctgatacggagggtgattccccatcatgtctgtattctgtgggtcacacagaccaaggccggtccactgtggaaggcaaggacgaggttgccagtgcccggcggtgggcggccacagccagcctccctgccagtgtcccccacagccaagttgtccctgtaagacaggtcagctcaggtcattccgagctcagaccttccaacggcgtccatgtccctcagtaaaagccagagtcctaaaggcctcttgcctgctctggcctcctctcaccattctctgccatcctccatctgcccctggtgtccctgaagtcttgaacatgccgagcacatcctgcctcgtatgcttcctggcctggaatgcacttgccccgggacaccctgtgctggctttagcgtttccttcctgtctcctcaagtcaccttattatcaaaaggactccgacaggctaagtgtggtggctcatgcctgtagtcccagcactcgggaaggccgaggtgggaggatcgcttgagcccaggagttcaggacctgcctgggcaacatggcaaaactttgtctctctt

SEQ ID NO: 1097 - DNA, 5739 bp, Homo sapiens
ttcctcctcctagccggactggagggagacaaagcagcgcccgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctcaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcagatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctggggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagaaaaacctgacaacatagagtttgctaaggcagtaatttagactttaccttatttgtgattactgtagtgattgattgattactattaactacaaggtataatttactatcaccttatttaaattttatgaattaatttgaatgttttttacactaactaacttttcccaataaagtccactatgaaaccacgacatccaagaggccaaagtcgtcttctctgccttcaagtcatagatttgcccgcagtatctgtggtgctctgggccctcccggtgtccgtctcttccaggatggggatgcccgggagggaaactgtctgtggctctaggctgcacggctcgtgccaacccatcagggagggccatgcccgttgtcctattgagtgccccaccctgcacccccaccttgggaattcacatgtccattccttgaggttcatgtcaacctcggaggcatccctgtcttcattatagctgacccctctcctgcgtccttctgtcagcatatcccttctgcatccttcccgtcacacatacataccaagctatgatgattgattgatagtggccttcgagatgaaaaccatccttaaccccatgatccttcccagctggcatccccaccctaagcaaggttccctaaagagaagcttgttgtcattttctccccttcctcacttacagtcagctgtcaccttgctccctccacctcccctcgtcaaggtgactgccttccactgccagccacactggcaattgtcttgagacctcaccgtgcaagcggcctgggggcgtggcggggaggaggaggaggacaaggactcctgaacgctgctcactcggcttccaggacaccccgctcaggttctgcctgccttactgggggctcctcctcctttcctggggctgagaggttgtgtctgtgcccactctcctgagctcagccagaatctcgcatgtaaagacatccaaatgccgacttcttctccccagagcctggcttttataactgactgccgcctcacgctccattcggatgtctaatgaatctctcagacttgacctgtccaaactgcttgccacctctactcgccaccgcccacccccacaccctccataccgttttccccacgtcactgcccctcccccccttcctcttgccaaatgcctaaaaataaaaattctgaggtggatctgtagcacaatgggcttctagtgacaaatcaaaattctgatctttaaaatgtatgcacaatttacctgttaccgcctggcctaagccatcctgctgttactgctgtgtagcaagttgcagccaaagcgacctcacacggctcctgaaggtcaagaatctgggagcagctcagctggatggctgtgactcggggtctcatgaagtggccaagatgccagctaaggctgccgtctctgaaggcttgacctggcgaggatttgcttccagactcactcgcgtggctattgacagaaggcctcagttccatgccacatggcccgttccacagagcagctcacagcttggtagtagctggcttccccagagcggtatctgcgagcagcgtccagatggaagccatggtgttcccttaaaacctgatacggagggtgattccccatcatgtctgtattctgtgggtcacacagaccaaggccggtccactgtggaaggcaaggacgaggttgccagtgcccggcggtgggcggccacagccagcctccctgccagtgtcccccacagccaagttgtccctgtaagacaggtcagctcaggtcattccgagctcagaccttccaacggcgtccatgtccctcagtaaaagccagagtcctaaaggcctcttgcctgctctggcctcctctcaccattctctgccatcctccatctgcccctggtgtccctgaagtcttgaacatgccgagcacatcctgcctcgtatgcttcctggcctggaatgcacttgccccgggacaccctgtgctggctttagcgtttccttcctgtctcctcaagtcaccttattatcaaaaggactccgacaggctaagtgtggtggctcatgcctgtagtcccagcactcgggaaggccgaggtgggaggatcgcttgagcccaggagttcaggacctgcctgggcaacatggcaaaactttgtctctctt

SEQ ID NO: 1098 - DNA, 5995 bp, Homo sapiens
gttgggcagtcgctggcgctgccgctggtggtccctgtgcttgaagtgccggtggtatcggagtccatgcacccaaggcccagcacccagcaacattctctggcccagcagaggggataccccaaaccaagacagatgtctcacaaaacacaagcagagatgtcagtcttcaggcctcgcatggagaagatgaaagagaggggtggcttttccaaagcccagcgtcagcacgaagcttccacgagattattttccctcttattttgaagtcctgaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctcaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcagatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctgggaactgtgacacctgcggggcactgcaagggctgaaaggctggcctcctcccctttgctggccactcactgggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagaaaaacctgacaacatagagtttgctaaggcagtaatttagactttaccttatttgtgattactgtagtgattgattgattactattaactacaaggtataatttactatcaccttatttaaattttatgaattaatttgaatgttttttacactaactaacttttcccaataaagtccactatgaaaccacgacatccaagaggccaaagtcgtcttctctgccttcaagtcatagatttgcccgcagtatctgtggtgctctgggccctcccggtgtccgtctcttccaggatggggatgcccgggagggaaactgtctgtggctctaggctgcacggctcgtgccaacccatcagggagggccatgcccgttgtcctattgagtgccccaccctgcacccccaccttgggaattcacatgtccattccttgaggttcatgtcaacctcggaggcatccctgtcttcattatagctgacccctctcctgcgtccttctgtcagcatatcccttctgcatccttcccgtcacacatacataccaagctatgatgattgattgatagtggccttcgagatgaaaaccatccttaaccccatgatccttcccagctggcatccccaccctaagcaaggttccctaaagagaagcttgttgtcattttctccccttcctcacttacagtcagctgtcaccttgctccctccacctcccctcgtcaaggtgactgccttccactgccagccacactggcaattgtcttgagacctcaccgtgcaagcggcctgggggcgtggcggggaggaggaggaggacaaggactcctgaacgctgctcactcggcttccaggacaccccgctcaggttctgcctgccttactgggggctcctcctcctttcctggggctgagaggttgtgtctgtgcccactctcctgagctcagccagaatctcgcatgtaaagacatccaaatgccgacttcttctccccagagcctggcttttataactgactgccgcctcacgctccattcggatgtctaatgaatctctcagacttgacctgtccaaactgcttgccacctctactcgccaccgcccacccccacaccctccataccgttttccccacgtcactgcccctcccccccttcctcttgccaaatgcctaaaaataaaaattctgaggtggatctgtagcacaatgggcttctagtgacaaatcaaaattctgatctttaaaatgtatgcacaatttacctgttaccgcctggcctaagccatcctgctgttactgctgtgtagcaagttgcagccaaagcgacctcacacggctcctgaaggtcaagaatctgggagcagctcagctggatggctgtgactcggggtctcatgaagtggccaagatgccagctaaggctgccgtctctgaaggcttgacctggcgaggatttgcttccagactcactcgcgtggctattgacagaaggcctcagttccatgccacatggcccgttccacagagcagctcacagcttggtagtagctggcttccccagagcggtatctgcgagcagcgtccagatggaagccatggtgttcccttaaaacctgatacggagggtgattccccatcatgtctgtattctgtgggtcacacagaccaaggccggtccactgtggaaggcaaggacgaggttgccagtgcccggcggtgggcggccacagccagcctccctgccagtgtcccccacagccaagttgtccctgtaagacaggtcagctcaggtcattccgagctcagaccttccaacggcgtccatgtccctcagtaaaagccagagtcctaaaggcctcttgcctgctctggcctcctctcaccattctctgccatcctccatctgcccctggtgtccctgaagtcttgaacatgccgagcacatcctgcctcgtatgcttcctggcctggaatgcacttgccccgggacaccctgtgctggctttagcgtttccttcctgtctcctcaagtcaccttattatcaaaaggactccgacaggctaagtgtggtggctcatgcctgtagtcccagcactcgggaaggccgaggtgggaggatcgcttgagcccaggagttcaggacctgcctgggcaacatggcaaaactttgtctctctt

SEQ ID NO: 1099 - DNA, 2699 bp, Homo sapiens
  misc_feature (1)...(2699): n = A,T,C or G
ggcccgcggcggccgaaatccgcggttcacagcatgtccgcctcggcccctgctgcggagggggagggaacccccacccagcccgcgtccgagaaagaacccgaaatgcccggtcccagagaggagagcgaggaggaagaggacgaggacgacgaggaggaggaggaggaggaaaaagaaaagagtctcatcgtggaaggcaagagggaaaagaaaaaagtagagaggttgacaatgcaagtctcttccttacagagagagccatttacaattgcacaaggaaaggggcagaaactttgtgaaattgagaggatacatttttttctaagtaagaagaaaaccgatgaacttagaaatctacacaaactgctttacaacaggccaggcactgtgtcctcattaaagaagaatgtgggtcagttcagtggctttccatttgaaaaaggaagtgtccaatataaaaagaaggaagaaatgttgaaaaaatttagaaatgccatgttaaagagcatctgtgaggttcttgatttggagagatcaggtgtaaatagtgaactagtgaagaggatcttgaatttcttaatgcatccaaagccttctggcaaaccattgccgaaatctaaaaaaacttgtagcaaaggcagtaaaaaggaacggaacagttctggaatggcaaggaaggctaagcgaaccaaatgtcctgaaattctgtcagatgaatctagtagtgatgaagatgaaaagaaaaacaaggaagagtcttcagatgatgaagataaagaaagtgaagaggagccaccaaaaaagacagccaaaagagaaaaacctaaacagaaagctacttctaaaagtaaaaaatctgtgaaaagtgccaatgttaagaaagcagatagcagcaccaccaagaagaatcaaaacagttccaaaaaagaaagtgagtctgaggatagttcagatgatgaacctttaattaaaaagttgaagaaaccccctacagatgaagagttaaaggaaacaataaagaaattactggccagtgctaacttggaagaagtcacaatgaaacagatttgcaaaaaggtctatgaaaattatcctacttatgatttaactgaaagaaaagatttcataaaaacaactgtaaaagagctaatttcttgagatagaggacagagaagatgactcgttcccatagatttgaagatctgatttataccattataccagcaaagagaatgtatttccttttctaaatccttgttaagcaacgttagtagaacttactgctgacctttttatcttgagtgttatgtgaatttgagtttgctgttttaaattgcatttctatgccatttttagtttaaaatcttgcatggcattaattgttccttgcttttatagttgtattttgtacattttggatttctttatataaggtcatagattcttgagctgttgtggtttttagtgcacttaatattagcttgcttaaggcatacttttaatcaagtagaacaaaaactattatcaccaggatttatacatacagagattgtagtatttagtatatgaaatattttgaatacacatctctgtcagtgtgaaaattcagcggcagtgtgtccatcatattaaaaatatacaagctacagttgtccagatcactgaattggaacttttctcctgcatgtgtatatatgtcaaattgtcagcatgacaaaagtgacagatgttattttngtatttttaaaaaacaattggttgtatataaagtttttttatttcttttgtgcagatcactttttaaactcacataggtaggtatctttatagttgtagactatggaatgtcagtgttcagccaaacagtatgatggaacagtgaaagtcaattcagtgatggcaacactgaaggaacagttaccctgctttgcctcgaaagtgtcatcaatttgtaattttagtattaactctgtaaaagtgtctgtaggtacgttttatattatataaggacagaccaaaaatcaacctatcaaagcttcaaaaactttgggaaagggtgggattaagtacaagcacatttggcttacagtaaatgaactgatttttattaactgcttttgcccatataaaatgctgatatttactggaaacctagccagcttcacgattatgactaaagtaccagattataatgccagaatataatgtgcaggcaatcgtggatgtctctgacaaagtgtgtctcaaaaataatatacttttacattaaagaaatttaatgtttctctggagttggggctcttggctttcagagtttggttaatcagtgttgattctagatgatcaacataatggaccactcctgaatgagacttaattttgtctttcaaatttactgtcttaaatcagtttattaaatctgaattttaaaacatgctgtttatgacacaatgacacatttgttgcaccaattaagtgttgaaaaatatctttgcatcatagaacagaaatatataaaaatatatgttgaatgttaacaggtattttcacaggtttgtttcttgatagttactcagacactagggaaaggtaaatacaagtgaacaaaataagcaactaaatgagacctaataattggccttcgattttaaatatttgttcttataaaccttgtcaataaaaataaatctaaatca

SEQ ID NO: 1100 - DNA, 3211 bp, Homo sapiens
accgccattttgaaaatcttgttgattctggggagccgagcgcgcggcgcgagcgtcacgccagacagcggcccgcgcgccttctcctcggcgtcggccgccgccgcctcccagaacctcctcgtgccctcgcgtgccaggcccgcggcggccgaaatccgcggttcacagcatgtccgcctcggcccctgctgcggagggggagggaacccccacccagcccgcgtccgagaaagaacccgaaatgcccggtcccagagaggagagcgaggaggaagaggacgaggacgacgaggaggaggaggaggaggaaaaagaaaagagtctcatcgtggaaggcaagagggaaaagaaaaaagtagagaggttgacaatgcaagtctcttccttacagagagagccatttacaattgcacaaggaaaggggcagaaactttgtgaaattgagaggatacatttttttctaagtaagaagaaaaccgatgaacttagaaatctacacaaactgctttacaacaggccaggcactgtgtcctcattaaagaagaatgtgggtcagttcagtggctttccatttgaaaaaggaagtgtccaatataaaaagaaggaagaaatgttgaaaaaatttagaaatgccatgttaaagagcatctgtgaggttcttgatttggagagatcaggtgtaaatagtgaactagtgaagaggatcttgaatttcttaatgcatccaaagccttctggcaaaccattgccgaaatctaaaaaaacttgtagcaaaggcagtaaaaaggaacggaacagttctggaatggcaaggaaggctaagcgaaccaaatgtcctgaaattctgtcagatgaatctagtagtgatgaagatgaaaagaaaaacaaggaagagtcttcagatgatgaagataaagaaagtgaagaggagccaccaaaaaagacagccaaaagagaaaaacctaaacagaaagctacttctaaaagtaaaaaatctgtgaaaagtgccaatgttaagaaagcagatagcagcaccaccaagaagaatcaaaacagttccaaaaaagaaagtgagtctgaggatagttcagatgatgaacctttaattaaaaagttgaagaaaccccctacagatgaagagttaaaggaaacaataaagaaattactggccagtgctaacttggaagaagtcacaatgaaacagatttgcaaaaaggtctatgaaaattatcctacttatgatttaactgaaagaaaagatttcataaaaacaactgtaaaagaggtaaatatttcagtctttcaagtttgactttagaaatataagacaaaagtaattacataaaatactccatatttttcaaaatattcatgtcactaaatatcacatttgatcctcacatttcttcataatagggaaatttatttcttctcattcccactttaaagcttaaaattaaagtttgaacagttagtgataagacctgaactcagattatgatgtggcctcatggtgtacctgggtagctgggcatctcaacgttgctctcacaaatacttgaggaagttcctgtctacgaggcaaaggtgaggggaagatcagcaggtagctgtaattctgtattgatctcaactgatttttgaaggacaaaatagtaaaatagatgtggaaaaaatgggataaaggtttatgatttatggcaaaataatgtttctctttcattacagctaatttcttgagatagaggacagagaagatgactcgttcccatagatttgaagatctgatttataccattataccagcaaagagaatgtatttccttttctaaatccttgttaagcaacgttagtagaacttactgctgacctttttatcttgagtgttatgtgaatttgagtttgctgttttaaattgcatttctatgccatttttagtttaaaatcttgcatggcattaattgttccttgcttttatagttgtattttgtacattttggatttctttatataaggtcatagattcttgagctgttgtggtttttagtgcacttaatattagcttgcttaaggcatacttttaatcaagtagaacaaaaactattatcaccaggatttatacatacagagattgtagtatttagtatatgaaatattttgaatacacatctctgtcagtgtgaaaattcagcggcagtgtgtccatcatattaaaaatatacaagctacagttgtccagatcactgaattggaacttttctcctgcatgtgtatatatgtcaaattgtcagcatgacaaaagtgacagatgttatttttgtatttttaaaaaacaattggttgtatataaagtttttttatttcttttgtgcagatcactttttaaactcacataggtaggtatctttatagttgtagactatggaatgtcagtgttcagccaaacagtatgatggaacagtgaaagtcaattcagtgatggcaacactgaaggaacagttaccctgctttgcctcgaaagtgtcatcaatttgtaattttagtattaactctgtaaaagtgtctgtaggtacgttttatattatataaggacagaccaaaaatcaacctatcaaagcttcaaaaactttgggaaagggtgggattaagtacaagcacatttggcttacagtaaatgaactgatttttattaactgaaaataatatacttttacattaaagaaatttaatgtttctctggagttggggctcttggctttcagagtttggttaatcagtgttgattctagatgatcaacataatggaccactcctgaatgagacttaattttgtctttcaaatttactgtcttaaatcagtttattaaatctgaattttaaaacatgctgtttatgacacaatgacacatttgttgcaccaattaagtgttgaaaaatatctttgcatcatagaacagaaatatataaaaatatatgttgaatgttaacaggtattttcacaggtttgtttcttgatagttactcagacactagggaaaggtaaatacaagtgaacaaaataagcaactaaatgagacctaataattggccttcgattttaaatatttgttcttataaaccttgtcaataaaaataaatctaaatcactggtgttttaagtcacttgcatttgatatcttataggtgtatatagcatttccttatgggg

SEQ ID NO: 1101 - DNA, 2737 bp, Homo sapiens
gttcacagcatgtccgcctcggcccctgctgcggagggggagggaacccccacccagcccgcgtccgagaaagaacccgaaatgcccggtcccagagaggagagcgaggaggaagaggacgaggacgacgaggaggaggaggaggaggaaaaagaaaagagtctcatcgtggaaggcaagagggaaaagaaaaaagtagagaggttgacaatgcaagtctcttccttacagagagagccatttacaattgcacaaggaaaggggcagaaactttgtgaaattgagaggatacatttttttctaagtaagaagaaaaccgatgaacttagaaatctacacaaactgctttacaacaggccaggcactgtgtcctcattaaagaagaatgtgggtcagttcagtggctttccatttgaaaaaggaagtgtccaatataaaaagaaggaagaaatgttgaaaaaatttagaaatgccatgttaaagagcatctgtgaggttcttgatttggagagatcaggtgtaaatagtgaactagtgaagaggatcttgaatttcttaatgcatccaaagccttctggcaaaccattgccgaaatctaaaaaaacttgtagcaaaggcagtaaaaaggaacggaacagttctggaatggcaaggaaggctaagcgaaccaaatgtcctgaaattctgtcagatgaatctagtagtgatgaagatgaaaagaaaaacaaggaagagtcttcagatgatgaagataaagaaagtgaagaggagccaccaaaaaagacagccaaaagagaaaaacctaaacagaaagctacttctaaaagtaaaaaatctgtgaaaagtgccaatgttaagaaagcagatagcagcaccaccaagaagaatcaaaacagttccaaaaaagaaagtgagtctgaggatagttcagatgatgaacctttaattaaaaagttgaagaaaccccctacagatgaagagttaaaggaaacaataaagaaattactggccagtgctaacttggaagaagtcacaatgaaacagatttgcaaaaaggtctatgaaaattatcctacttatgatttaactgaaagaaaagatttcataaaaacaactgtaaaagagctaatttcttgagatagaggacagagaagatgactcgttcccatagatttgaagatctgatttataccattataccagcaaagagaatgtatttccttttctaaatccttgttaagcaacgttagtagaacttactgctgacctttttatcttgagtgttatgtgaatttgagtttgctgttttaaattgcatttctatgccatttttagtttaaaatcttgcatggcattaattgttccttgcttttatagttgtattttgtacattttggatttctttatataaggtcatagattcttgagctgttgtggtttttagtgcacttaatattagcttgcttaaggcatacttttaatcaagtagaacaaaaactattatcaccaggatttatacatacagagattgtagtatttagtatatgaaatattttgaatacacatctctgtcagtgtgaaaattcagcggcagtgtgtccatcatattaaaaatatacaagctacagttgtccagatcactgaattggaacttttctcctgcatgtgtatatatgtcaaattgtcagcatgacaaaagtgacagatgttatttttgtatttttaaaaaacaattggttgtatataaagtttttttatttcttttgtgcagatcactttttaaactcacataggtaggtatctttatagttgtagactatggaatgtcagtgttcagccaaacagtatgatggaacagtgaaagtcaattcagtgatggcaacactgaaggaacagttaccctgctttgcctcgaaagtgtcatcaatttgtaattttagtattaactctgtaaaagtgtctgtaggtacgttttatattatataaggacagaccaaaaatcaacctatcaaagcttcaaaaactttgggaaagggtgggattaagtacaagcacatttggcttacagtaaatgaactgatttttattaactgcttttgcccatataaaatgctgatatttactggaaacctagccagcttcacgattatgactaaagtaccagattataatgccagaatataatgtgcaggcaatcgtggatgtctctgacaaagtgtgtctcaaaaataatatacttttacattaaagaaatttaatgtttctctggagttggggctcttggctttcagagtttggttaatcagtgttgattctagatgatcaacataatggaccactcctgaatgagacttaattttgtctttcaaatttactgtcttaaatcagtttattaaatctgaattttaaaacatgctgtttatgacacaatgacacatttgttgcaccaattaagtgttgaaaaatatctttgcatcatagaacagaaatatataaaaatatatgttgaatgttaacaggtattttcacaggtttgtttcttgatagttactcagacactagggaaaggtaaatacaagtgaacaaaataagcaactaaatgagacctaataattggccttcgattttaaatatttgttcttataaaccttgtcaataaaaataaatctaaatcactggtgttttaagtcacttgcatttgatatcttataggtgtatatagcatttccttatgggg

SEQ ID NO: 1102 - DNA, 2900 bp, Homo sapiens
accgccattttgaaaatcttgttgattctggggagccgagcgcgcggcgcgagcgtcacgccagacagcggcccgcgcgccttctcctcggcgtcggccgccgccgcctcccagaacctcctcgtgccctcgcgtgccaggcccgcggcggccgaaatccgcggttcacagcatgtccgcctcggcccctgctgcggagggggagggaacccccacccagcccgcgtccgagaaagaacccgaaatgcccggtcccagagaggagagcgaggaggaagaggacgaggacgacgaggaggaggaggaggaggaaaaagaaaagagtctcatcgtggaaggcaagagggaaaagaaaaaagtagagaggttgacaatgcaagtctcttccttacagagagagccatttacaattgcacaaggaaaggggcagaaactttgtgaaattgagaggatacatttttttctaagtaagaagaaaaccgatgaacttagaaatctacacaaactgctttacaacaggccaggcactgtgtcctcattaaagaagaatgtgggtcagttcagtggctttccatttgaaaaaggaagtgtccaatataaaaagaaggaagaaatgttgaaaaaatttagaaatgccatgttaaagagcatctgtgaggttcttgatttggagagatcaggtgtaaatagtgaactagtgaagaggatcttgaatttcttaatgcatccaaagccttctggcaaaccattgccgaaatctaaaaaaacttgtagcaaaggcagtaaaaaggaacggaacagttctggaatggcaaggaaggctaagcgaaccaaatgtcctgaaattctgtcagatgaatctagtagtgatgaagatgaaaagaaaaacaaggaagagtcttcagatgatgaagataaagaaagtgaagaggagccaccaaaaaagacagccaaaagagaaaaacctaaacagaaagctacttctaaaagtaaaaaatctgtgaaaagtgccaatgttaagaaagcagatagcagcaccaccaagaagaatcaaaacagttccaaaaaagaaagtgagtctgaggatagttcagatgatgaacctttaattaaaaagttgaagaaaccccctacagatgaagagttaaaggaaacaataaagaaattactggccagtgctaacttggaagaagtcacaatgaaacagatttgcaaaaaggtctatgaaaattatcctacttatgatttaactgaaagaaaagatttcataaaaacaactgtaaaagagctaatttcttgagatagaggacagagaagatgactcgttcccatagatttgaagatctgatttataccattataccagcaaagagaatgtatttccttttctaaatccttgttaagcaacgttagtagaacttactgctgacctttttatcttgagtgttatgtgaatttgagtttgctgttttaaattgcatttctatgccatttttagtttaaaatcttgcatggcattaattgttccttgcttttatagttgtattttgtacattttggatttctttatataaggtcatagattcttgagctgttgtggtttttagtgcacttaatattagcttgcttaaggcatacttttaatcaagtagaacaaaaactattatcaccaggatttatacatacagagattgtagtatttagtatatgaaatattttgaatacacatctctgtcagtgtgaaaattcagcggcagtgtgtccatcatattaaaaatatacaagctacagttgtccagatcactgaattggaacttttctcctgcatgtgtatatatgtcaaattgtcagcatgacaaaagtgacagatgttatttttgtatttttaaaaaacaattggttgtatataaagtttttttatttcttttgtgcagatcactttttaaactcacataggtaggtatctttatagttgtagactatggaatgtcagtgttcagccaaacagtatgatggaacagtgaaagtcaattcagtgatggcaacactgaaggaacagttaccctgctttgcctcgaaagtgtcatcaatttgtaattttagtattaactctgtaaaagtgtctgtaggtacgttttatattatataaggacagaccaaaaatcaacctatcaaagcttcaaaaactttgggaaagggtgggattaagtacaagcacatttggcttacagtaaatgaactgatttttattaactgcttttgcccatataaaatgctgatatttactggaaacctagccagcttcacgattatgactaaagtaccagattataatgccagaatataatgtgcaggcaatcgtggatgtctctgacaaagtgtgtctcaaaaataatatacttttacattaaagaaatttaatgtttctctggagttggggctcttggctttcagagtttggttaatcagtgttgattctagatgatcaacataatggaccactcctgaatgagacttaattttgtctttcaaatttactgtcttaaatcagtttattaaatctgaattttaaaacatgctgtttatgacacaatgacacatttgttgcaccaattaagtgttgaaaaatatctttgcatcatagaacagaaatatataaaaatatatgttgaatgttaacaggtattttcacaggtttgtttcttgatagttactcagacactagggaaaggtaaatacaagtgaacaaaataagcaactaaatgagacctaataattggccttcgattttaaatatttgttcttataaaccttgtcaataaaaataaatctaaatcactggtgttttaagtcacttgcatttgatatcttataggtgtatatagcatttccttatgggg

SEQ ID NO: 1103 - DNA, 3226 bp, Homo sapiens; identical to SEQ ID NO: 1030

SEQ ID NO: 1104 - DNA, 2720 bp, Homo sapiens
gagaagagctggaggaagtgagaggtcggctgggggtcctcaaagtgagaggggagcagaggatcctcccgtgcaggctgtggatgtcactcacttcccagctggtgaagcctcgctgcagagatgcatctgctcccagccctggcaggggtcctggccacactcgtcctcgcccagccctgtgagggcactgacccagcctcccctggggcagtggagacctcggtcctgcgagactgcatagcagaggccaagttgctggtggatgctgcctacaattggacccagaagagcatcaagcagcggcttcgcagcggttcagccagccccatggacctcctgtcctacttcaaacaaccggtagcagccaccaggacagttgttcgggccgcagattatatgcatgtggctttggggctgcttgaagagaagttacaaccccagcggtccggacccttcaatgtcactgatgtgctaacagaaccacagctgcggctgctgtcccaggccagtggctgtgctctccgggaccaggccgagcgctgcagcgacaagtaccgcaccatcactggacggtgcaacaacaagaggagacccttgctaggggcctccaaccaggctctggctcgctggctgcccgccgagtatgaggatgggctgtcgctccccttcggctggacccccagcaggaggcgcaatggcttccttctccctcttgtccgggctgtctccaaccagattgtgcgcttccccaatgagagactgacctccgaccgtggccgagccctcatgttcatgcagtggggccagttcattgaccatgacctggacttctccccggagtccccggccagagtggccttcactgcaggcgttgactgtgagaggacctgcgcccagctgcccccctgctttcccatcaagatcccacccaatgacccccgcatcaagaaccagcgtgactgcatccctttcttccgctcggcaccctcatgcccccaaaacaagaacagagtccgcaaccagatcaacgcgctcacctcctttgtggacgccagcatggtgtatggcagtgaggtctccctctcgctgcggctccgcaaccggaccaactacctggggctgctggccatcaaccagcgctttcaagacaacggccgggccctgctgcccttcgacaacctgcacgatgacccctgtctcctcaccaaccgctcggcgcgcatcccctgcttcctggcaggtgacacccgatcaacggaaacccccaaactggcagccatgcacaccctctttatgcgagagcacaaccggctggccaccgagctgagacgcctgaatccccggtggaatggagacaaactgtacaatgaggctcggaagatcatgggggccatggtccagatcatcacctaccgagactttctgcccctggttctgggcaaggcccgggccaggagaaccctggggcactacagggggtactgctccaatgtggacccacgggtggccaatgtcttcaccctggccttccgctttggccacacaatgctccagcccttcatgttccgcttggacagtcagtaccgggcctccgcacccaactcgcatgtcccacttagctctgccttctttgccagctggcggatcgtgtatgaagggggcatcgaccccatcctccggggcctcatggccacccctgccaagctgaaccgtcaggatgccatgttagtggatgagctccgggaccggctgtttcggcaagtgaggaggattgggctggacctggcagctctcaacatgcaacgaagccgggaccacggccttccagggtacaatgcttggaggcgcttctgtgggctctcccagccccggaatttggcacagcttagccgggtgctgaaaaaccaggacttggcaaggaagttcctgaatttgtatggaacacctgacaacattgacatctggattggggccatcgctgagcctcttttgccgggggctcgagtggggcctcttctggcttgtctgttcgagaaccagttcagaagagcccgagacggagacaggttctggtggcagaaacgaggtgttttcaccaaaagacagcgcaaggccctgagcagaatttccttgtctcgaattatatgtgacaataccggtatcaccacggtttcaagggacatcttcagagccaacatctaccctcggggctttgtgaactgcagccgtatccccaggttgaacctatcagcctggcgagggacatgaggcttctgcaggagtctatcccaagtctccaacttttggagacaaggggaaggggaggaccatgaggctgccttgtctccctggagcaagtgcaggctgctgacgcttctgctggctacagctcagagctgggttccccagccaggagtgaaggctgggggctcctatcagcaatggaccttcccgccttgggagcctcttaggtattaggctatgaatcagcgccacgtgcaaaggcttgggagccaagccatgtggtcttgcaccccaggcaagaaaagtcagctggagggtttacagcactttctactgtttcccagccctccctcccctccctcaccatgactaagagaccactcggtcctagcctccagacaccccacaatactcctctgagcctgaggccaggcagcatgctctgcttctaccaataaagcactgctaagggc

SEQ ID NO: 1105 - DNA, 2664 bp, Homo sapiens
gagaagagctggaggaagtgagaggtcggctgggggtcctcaaagtgagaggggagcagaggatcctcccgtgcaggctgtggatgtcactcacttcccagctggtgaagcctcgctgcagagatgcatctgctcccagccctggcaggggtcctggccacactcgtcctcgcccagccctgtgagggcactgacccagcctcccctggggcagtggagacctcggtcctgcgagactgcatagcagaggccaagttgctggtggatgctgcctacaattggacccagaagagcatcaagcagcggcttcgcagcggttcagccagccccatggacctcctgtcctacttcaaacaaccggtagcagccaccaggacagttgttcgggccgcagattatatgcatgtggctttggggctgcttgaagagaagttacaaccccagcggtccggacccttcaatgtcactgatgtgctaacagaaccacagctgcggctgctgtcccaggccagtggctgtgctctccgggaccaggccgagcgctgcagcgacaagtaccgcaccatcactggacggtgcaacaacaagaggagacccttgctaggggcctccaaccaggctctggctcgctggctgcccgccgagtatgaggatgggctgtcgctccccttcggctggacccccagcaggaggcgcaatggcttccttctccctcttgtccgggctgtctccaaccagattgtgcgcttccccaatgagagactgacctccgaccgtggccgagccctcatgttcatgcagtggggccagttcattgaccatgacctggacttctccccggagtccccggccagagtggccttcactgcaggcgttgactgtgagaggacctgcgcccagctgcccccctgctttcccatcaagatcccacccaatgacccccgcatcaagaaccagcgtgactgcatccctttcttccgctcggcaccctcatgcccccaaaacaagaacagagtccgcaaccagatcaacgcgctcacctcctttgtggacgccagcatggtgtatggcagtgaggtctccctctcgctgcggctccgcaaccggaccaactacctggggctgctggccatcaaccagcgctttcaagacaacggccgggccctgctgcccttcgacaacctgcacgatgacccctgtctcctcaccaaccgctcggcgcgcatcccctgcttcctggcaggtgacacccgatcaacggaaacccccaaactggcagccatgcacaccctctttatgcgagagcacaaccggctggccaccgagctgagacgcctgaatccccggtggaatggagacaaactgtacaatgaggctcggaagatcatgggggccatggtccagatcatcacctaccgagactttctgcccctggttctgggcaaggcccgggccaggagaaccctggggcactacagggggtactgctccaatgtggacccacgggtggccaatgtcttcaccctggccttccgctttggccacacaatgctccagcccttcatgttccgcttggacagtcagtaccgggcctccgcacccaactcgcatgtcccacttagctctgccttctttgccagctggcggatcgtgtatgaaggtgaccaggttttccagggggcaaatggggggggcatcgaccccatcctccggggcctcatggccacccctgccaagctgaaccgtcaggatgccatgttagtggatgagctccgggaccggctgtttcggcaagtgaggaggattgggctggacctggcagctctcaacatgcaacgaagccgggaccacggccttccagggtacaatgcttggaggcgcttctgtgggctctcccagccccggaatttggcacagcttagccgggtgctgaaaaaccaggacttggcaaggaagttcctgaatttgtatggaacacctgacaacattgacatctggattggggccatcgctgagcctcttttgccgggggctcgagtggggcctcttctggcttgtctgttcgagaaccagttcagaagagcccgagacggagacaggtaagtgaccctatcataaaagacatcagcaccagaggcagagcagaaaaacactagcatttcaagactaaacattgaagaacactgctctttttagtatcatttcttccaagttcacaggatctgaaatcaggaggctcctctctgaaaagctgggtcaaaggaagagagacactgacccaggcaaggcccatattgcctgagctggagtcatcttaaacccagaggttgcctggcagcctcactattctgggttggtggatcccagaaaacatgggcagaaagggctaaatctggtttccctccaatacatttgtgatttaagacctgacggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccggctacttgggaggctgaggcaggagaatggcgtgaacccgggaggcggagcttgcagtgagccgag

SEQ ID NO: 1106 - DNA, 2282 bp, Homo sapiens
gagaagagctggaggaagtgagaggtcggctgggggtcctcaaagtgagaggggagcagaggatcctcccgtgcaggctgtggatgtcactcacttcccagctggtgaagcctcgctgcagagatgcatctgctcccagccctggcaggggtcctggccacactcgtcctcgcccagccctgtgagggcactgacccagcctcccctggggcagtggagacctcggtcctgcgagactgcatagcagaggccaagttgctggtggatgctgcctacaattggacccagaagagcatcaagcagcggcttcgcagcggttcagccagccccatggacctcctgtcctacttcaaacaaccggtagcagccaccaggacagttgttcgggccgcagattatatgcatgtggctttggggctgcttgaagagaagttacaaccccagcggtccggacccttcaatgtcactgatgtgctaacagaaccacagctgcggctgctgtcccaggccagtggctgtgctctccgggaccaggccgagcgctgcagcgacaagtaccgcaccatcactggacggtgcaacaacaagaggagacccttgctaggggcctccaaccaggctctggctcgctggctgcccgccgagtatgaggatgggctgtcgctccccttcggctggacccccagcaggaggcgcaatggcttccttctccctcttgtccgggctgtctccaaccagattgtgcgcttccccaatgagagactgacctccgaccgtggccgagccctcatgttcatgcagtggggccagttcattgaccatgacctggacttctccccggagtccccggccagagtggccttcactgcaggcgttgactgtgagaggacctgcgcccagctgcccccctgctttcccatcaagatcccacccaatgacccccgcatcaagaaccagcgtgactgcatccctttcttccgctcggcaccctcatgcccccaaaacaagaacagagtccgcaaccagatcaacgcgctcacctcctttgtggacgccagcatggtgtatggcagtgaggtctccctctcgctgcggctccgcaaccggaccaactacctggggctgctggccatcaaccagcgctttcaagacaacggccgggccctgctgcccttcgacaacctgcacgatgacccctgtctcctcaccaaccgctcggcgcgcatcccctgcttcctggcaggtgacacccgatcaacggaaacccccaaactggcagccatgcacaccctctttatgcgagagcacaaccggctggccaccgagctgagacgcctgaatccccggtggaatggagacaaactgtacaatgaggctcggaagatcatgggggccatggtccagatcatcacctaccgagactttctgcccctggttctgggcaaggcccgggccaggagaaccctggggcactacagggggtactgctccaatgtggacccacgggtggccaatgtcttcaccctggccttccgctttggccacacaatgctccagcccttcatgttccgcttggacagtcagtaccgggcctccgcacccaactcgcatgtcccacttagctctgccttctttgccagctggcggatcgtgtatgaagggggcatcgaccccatcctccggggcctcatggccacccctgccaagctgaaccgtcaggatgccatgttagtggatgagctccgggaccggctgtttcggcaagtgaggaggattgggctggacctggcagctctcaacatgcaacgaagccgggaccacggccttccagggtacaatgcttggaggcgcttctgtgggctctcccagccccggaatttggcacagcttagccgggtgctgaaaaaccaggacttggcaaggaagttcctgaatttgtatggaacacctgacaacattgacatctggattggggccatcgctgagcctcttttgccgggggctcgagtggggcctcttctggcttgtctgttcgagaaccagttcagaagagcccgagacggagacaggttctggtggcagaaacgaggtgttttcaccaaaagacagcgcaaggccctgagcagaatttccttgtctcgaattatatgtgacaataccggtatcaccacggtttcaagggacatcttcagagccaacatctaccctcggggctttgtgaactgcagccgtatccccaggttgaacctatcagcctggcgagggacatgaggcttctgcag

SEQ ID NO: 1107 - DNA, 1391 bp, Homo sapiens
ctatgatggacgtattctctagccaattactagacggtattctcagacgggccgcctccattgccaatgaaatcttccagcggggtcgcggtaggcgggccgtggaccctctggtataaggcggtcccgggggagtgaggagaaagggggggtcttggcggccggaggaggagtaggtgcgggtgaagatggcggcagccgaggccgcgaactgcatcatggaggtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctggggtctggctttgtttcctgggggcaaaggaggtttggggttcctttcgcaggtactgcagtgccagcctcagcagtggggggaccggccttggcacctgctggtggctgccattctgtggatctgcgtctcccgtcccccgtctctaggcctcttgctccccttccttggttccttctcggggtccctgtcctccacagctgtctctcagggtctttgtccaactcttttcatc

SEQ ID NO: 1108 - DNA, 4294 bp, Homo sapiens
ttttgttgttgttgtttttttaattgcattgggattaggcaacagaagggtctaatgcggccgggatgagacaggagagtttttaggagggtagctgcgttctaagtaagggactctgctggggtaaaagaggcgcaagcgttgcaagaagggagtgcagggggttgagcaggcacctctacaggaaatggatgctgtccaggtgctggtgggcgccccagggctacgtggcgaagcagctcagccggtccaatcagagtgcgtccagggctcgggtttcgcgatctttaagtgactgaggcagatccccacgcggcacctggccatgctctcagctctcccgccgcgggatggtgccttgagtgaatgacccccttggagaacattcttccgcatccctcgcctcaagccagcctcagacagaaaactgaagattcagcagatccagtgcttcctgctcctcttctgcccaggaacacgcttgccttccccaaggcttccagaagctctgaggcaggaggcaccaagttctacctcatgtttggaggatcttgctagctatggccctcgtactcggctccctgttgctgctggggctgtgcgggaactccttttcaggagggcagccttcatccacagatgctcctaaggcttggaattatgaattgcctgcaacaaattatgagacccaagactcccataaagctggacccattggcattctctttgaactagtgcatatctttctctatgtggtacagccgcgtgatttcccagaagatactttgagaaaattcttacagaaggcatatgaatccaaaattgattatgacaagattgtctactatgaagcagggattattctatgctgtgtcctggggctgctgtttattattctgatgcctctggtggggtatttcttttgtatgtgtcgttgctgtaacaaatgtggtggagaaatgcaccagcgacagaaggaaaatgggcccttcctgaggaaatgctttgcaatctccctgttggtgatttgtataataataagcattggcatcttctatggttttgtggcaaatcaccaggtaagaacccggatcaaaaggagtcggaaactggcagatagcaatttcaaggacttgcgaactctcttgaatgaaactccagagcaaatcaaatatatattggcccagtacaacactaccaaggacaaggcgttcacagatctgaacagtatcaattcagtgctaggaggcggaattcttgaccgactgagacccaacatcatccctgttcttgatgagattaagtccatggcaacagcgatcaaggagaccaaagaggcgttggagaacatgaacagcaccttgaagagcttgcaccaacaaagtacacagcttagcagcagtctgaccagcgtgaaaactagcctgcggtcatctctcaatgaccctctgtgcttggtgcatccatcaagtgaaacctgcaacagcatcagattgtctctaagccagctgaatagcaaccctgaactgaggcagcttccacccgtggatgcagaacttgacaacgttaataacgttcttaggacagatttggatggcctggtccaacagggctatcaatcccttaatgatatacctgacagagtacaacgccaaaccacgactgtcgtagcaggtatcaaaagggtcttgaattccattggttcagatatcgacaatgtaactcagcgtcttcctattcaggatatactctcagcattctctgtttatgttaataacactgaaagttacatccacagaaatttacctacattggaagagtatgattcatactggtggctgggtggcctggtcatctgctctctgctgaccctcatcgtgattttttactacctgggcttactgtgtggcgtgtgcggctatgacaggcatgccaccccgaccacccgaggctgtgtctccaacaccggaggcgtcttcctcatggttggagttggattaagtttcctcttttgctggatattgatgatcattgtggttcttacctttgtctttggtgcaaatgtggaaaaactgatctgtgaaccttacacgagcaaggaattattccgggttttggatacaccctacttactaaatgaagactgggaatactatctctctgggaagctatttaataaatcaaaaatgaagctcacttttgaacaagtttacagtgactgcaaaaaaaatagaggcacttacggcactcttcacctgcagaacagcttcaatatcagtgaacatctcaacattaatgagcatactggaagcataagcagtgaattggaaagtctgaaggtaaatcttaatatctttctgttgggtgcagcaggaagaaaaaaccttcaggattttgctgcttgtggaatagacagaatgaattatgacagctacttggctcagactggtaaatcccccgcaggagtgaatcttttatcatttgcatatgatctagaagcaaaagcaaacagtttgcccccaggaaatttgaggaactccctgaaaagagatgcacaaactattaaaacaattcaccagcaacgagtccttcctatagaacaatcactgagcactctataccaaagcgtcaagatacttcaacgcacagggaatggattgttggagagagtaactaggattctagcttctctggattttgctcagaacttcatcacaaacaatacttcctctgttattattgaggaaactaagaagtatgggagaacaataataggatattttgaacattatctgcagtggatcgagttctctatcagtgagaaagtggcatcgtgcaaacctgtggccaccgctctagatactgctgttgatgtctttctgtgtagctacattatcgaccccttgaatttgttttggtttggcataggaaaagctactgtatttttacttccggctctaatttttgcggtaaaactggctaagtactatcgtcgaatggattcggaggacgtgtacgatgatgttgaaactatacccatgaaaaatatggaaaatggtaataatggttatcataaagatcatgtatatggtattcacaatcctgttatgacaagcccatcacaacattgatagctgatgttgaaactgcttgagcatcaggatactcaaagtggaaaggatcacagatttttggtagtttctgggtctacaaggactttccaaatccaggagcaacgccagtggcaacgtagtgactcaggcgggcaccaaggcaacggcaccattggtctctgggtagtgctttaagaatgaacacaatcacgttatagtccatggtccatcactattcaaggatgactccctcccttcctgtctatttttgttttttacttttttacactgagtttctatttagacactacaacatatggggtgtttgttcccattggatgcatttctatcaaaactctatcaaatgtgatggctagattctaacatattgccatgtgtggagtgtgctgaacacacaccagtttacaggaaagatgcattttgtgtacagtaaacggtgtatataccttttgttaccacagagttttttaaacaaatgagtattataggactttcttctaaatgagctaaataagtcaccattgacttcttggtgctgttgaaaataatccattttcactaaaagtgtgtgaaacctacagcatattcttcacgcagagattttcatctattatactttatcaaagattggccatgttccacttggaaatggcatgcaaaagcaatcatagagaaacctgcgtaactccatctgacaaattcaaaagagagagagagatcttgagagagaaatgctgttcgttcaaaagtggagttgttttaacagatgccaattacggtgtacagtttaacagagttttctgttgcattaggataaacattaattggagtgcagctaacatgagtatcatcagactagtatcaagtgttctaaaatgaaatatgagaagatcctgtcacaattcttagatctggtgtccagcatggatgaaacctttgagtttggtccctaaatttgcatgaaagcacaaggtaaatattcatttgcttcaggagtttcatgttggatctgtcattatcaaaagtgatcagcaatgaagaactggtcggacaaaatttaacgttgatgtaatggaattccagatgtaggcattccccccaggtcttttcatgtgcagattgcagttctgattcatttgaataaaaaggaacttggaaaa

SEQ ID NO: 1109 - DNA, 4321 bp, Homo sapiens
ttttgttgttgttgtttttttaattgcattgggattaggcaacagaagggtctaatgcggccgggatgagacaggagagtttttaggagggtagctgcgttctaagtaagggactctgctggggtaaaagaggcgcaagcgttgcaagaagggagtgcagggggttgagcaggcacctctacaggaaatggatgctgtccaggtgctggtgggcgccccagggctacgtggcgaagcagctcagccggtccaatcagagtgcgtccagggctcgggtttcgcgatctttaagtgactgaggcagatccccacgcggcacctggccatgctctcagctctcccgccgcgggatggtgccttgagtgaatgacccccttggagaacattcttccgcatccctcgcctcaagccagcctcagacagaaaactgaagattcagcagatccagtgcttcctgctcctcttctgcccaggaacacgcttgccttccccaaggcttccagaagctctgaggcaggaggcaccaagttctacctcatgtttggaggatcttgctagctatggccctcgtactcggctccctgttgctgctggggctgtgcgggaactccttttcaggagggcagccttcatccacagatgctcctaaggcttggaattatgaattgcctgcaacaaattatgagacccaagactcccataaagctggacccattggcattctctttgaactagtgcatatctttctctatgtggtacagccgcgtgatttcccagaagatactttgagaaaattcttacagaaggcatatgaatccaaaattgattatgacaagccagaaactgtaatcttaggtctaaagattgtctactatgaagcagggattattctatgctgtgtcctggggctgctgtttattattctgatgcctctggtggggtatttcttttgtatgtgtcgttgctgtaacaaatgtggtggagaaatgcaccagcgacagaaggaaaatgggcccttcctgaggaaatgctttgcaatctccctgttggtgatttgtataataataagcattggcatcttctatggttttgtggcaaatcaccaggtaagaacccggatcaaaaggagtcggaaactggcagatagcaatttcaaggacttgcgaactctcttgaatgaaactccagagcaaatcaaatatatattggcccagtacaacactaccaaggacaaggcgttcacagatctgaacagtatcaattcagtgctaggaggcggaattcttgaccgactgagacccaacatcatccctgttcttgatgagattaagtccatggcaacagcgatcaaggagaccaaagaggcgttggagaacatgaacagcaccttgaagagcttgcaccaacaaagtacacagcttagcagcagtctgaccagcgtgaaaactagcctgcggtcatctctcaatgaccctctgtgcttggtgcatccatcaagtgaaacctgcaacagcatcagattgtctctaagccagctgaatagcaaccctgaactgaggcagcttccacccgtggatgcagaacttgacaacgttaataacgttcttaggacagatttggatggcctggtccaacagggctatcaatcccttaatgatatacctgacagagtacaacgccaaaccacgactgtcgtagcaggtatcaaaagggtcttgaattccattggttcagatatcgacaatgtaactcagcgtcttcctattcaggatatactctcagcattctctgtttatgttaataacactgaaagttacatccacagaaatttacctacattggaagagtatgattcatactggtggctgggtggcctggtcatctgctctctgctgaccctcatcgtgattttttactacctgggcttactgtgtggcgtgtgcggctatgacaggcatgccaccccgaccacccgaggctgtgtctccaacaccggaggcgtcttcctcatggttggagttggattaagtttcctcttttgctggatattgatgatcattgtggttcttacctttgtctttggtgcaaatgtggaaaaactgatctgtgaaccttacacgagcaaggaattattccgggttttggatacaccctacttactaaatgaagactgggaatactatctctctgggaagctatttaataaatcaaaaatgaagctcacttttgaacaagtttacagtgactgcaaaaaaaatagaggcacttacggcactcttcacctgcagaacagcttcaatatcagtgaacatctcaacattaatgagcatactggaagcataagcagtgaattggaaagtctgaaggtaaatcttaatatctttctgttgggtgcagcaggaagaaaaaaccttcaggattttgctgcttgtggaatagacagaatgaattatgacagctacttggctcagactggtaaatcccccgcaggagtgaatcttttatcatttgcatatgatctagaagcaaaagcaaacagtttgcccccaggaaatttgaggaactccctgaaaagagatgcacaaactattaaaacaattcaccagcaacgagtccttcctatagaacaatcactgagcactctataccaaagcgtcaagatacttcaacgcacagggaatggattgttggagagagtaactaggattctagcttctctggattttgctcagaacttcatcacaaacaatacttcctctgttattattgaggaaactaagaagtatgggagaacaataataggatattttgaacattatctgcagtggatcgagttctctatcagtgagaaagtggcatcgtgcaaacctgtggccaccgctctagatactgctgttgatgtctttctgtgtagctacattatcgaccccttgaatttgttttggtttggcataggaaaagctactgtatttttacttccggctctaatttttgcggtaaaactggctaagtactatcgtcgaatggattcggaggacgtgtacgatgatgttgaaactatacccatgaaaaatatggaaaatggtaataatggttatcataaagatcatgtatatggtattcacaatcctgttatgacaagcccatcacaacattgatagctgatgttgaaactgcttgagcatcaggatactcaaagtggaaaggatcacagatttttggtagtttctgggtctacaaggactttccaaatccaggagcaacgccagtggcaacgtagtgactcaggcgggcaccaaggcaacggcaccattggtctctgggtagtgctttaagaatgaacacaatcacgttatagtccatggtccatcactattcaaggatgactccctcccttcctgtctatttttgttttttacttttttacactgagtttctatttagacactacaacatatggggtgtttgttcccattggatgcatttctatcaaaactctatcaaatgtgatggctagattctaacatattgccatgtgtggagtgtgctgaacacacaccagtttacaggaaagatgcattttgtgtacagtaaacggtgtatataccttttgttaccacagagttttttaaacaaatgagtattataggactttcttctaaatgagctaaataagtcaccattgacttcttggtgctgttgaaaataatccattttcactaaaagtgtgtgaaacctacagcatattcttcacgcagagattttcatctattatactttatcaaagattggccatgttccacttggaaatggcatgcaaaagcaatcatagagaaacctgcgtaactccatctgacaaattcaaaagagagagagagatcttgagagagaaatgctgttcgttcaaaagtggagttgttttaacagatgccaattacggtgtacagtttaacagagttttctgttgcattaggataaacattaattggagtgcagctaacatgagtatcatcagactagtatcaagtgttctaaaatgaaatatgagaagatcctgtcacaattcttagatctggtgtccagcatggatgaaacctttgagtttggtccctaaatttgcatgaaagcacaaggtaaatattcatttgcttcaggagtttcatgttggatctgtcattatcaaaagtgatcagcaatgaagaactggtcggacaaaatttaacgttgatgtaatggaattccagatgtaggcattccccccaggtcttttcatgtgcagattgcagttctgattcatttgaataaaaaggaacttggaaaa

SEQ ID NO: 1110 - DNA, 3973 bp, Homo sapiens
ggatggtgccttgagtgaatgacccccttggagaacattcttccgcatccctcgcctcaagccagcctcagacagaaaactgaagattcagcagatccagtgcttcctgctcctcttctgcccaggaacacgcttgccttccccaaggcttccagaagctctgaggcaggaggcaccaagttctacctcatgtttggaggatcttgctagctatggccctcgtactcggctccctgttgctgctggggctgtgcgggaactccttttcaggagggcagccttcatccacagatgctcctaaggcttggaattatgaattgcctgcaacaaattatgagacccaagactcccataaagctggacccattggcattctctttgaactagtgcatatctttctctatgtggtacagccgcgtgatttcccagaagatactttgagaaaattcttacagaaggcatatgaatccaaaattgattatgacaagccagaaactgtaatcttaggtctaaagattgtctactatgaagcagggattattctatgctgtgtcctggggctgctgtttattattctgatgcctctggtggggtatttcttttgtatgtgtcgttgctgtaacaaatgtggtggagaaatgcaccagcgacagaaggaaaatgggcccttcctgaggaaatgctttgcaatctccctgttggtgatttgtataataataagcattggcatcttctatggttttgtggcaaatcaccaggtaagaacccggatcaaaaggagtcggaaactggcagatagcaatttcaaggacttgcgaactctcttgaatgaaactccagagcaaatcaaatatatattggcccagtacaacactaccaaggacaaggcgttcacagatctgaacagtatcaattcagtgctaggaggcggaattcttgaccgactgagacccaacatcatccctgttcttgatgagattaagtccatggcaacagcgatcaaggagaccaaagaggcgttggagaacatgaacagcaccttgaagagcttgcaccaacaaagtacacagcttagcagcagtctgaccagcgtgaaaactagcctgcggtcatctctcaatgaccctctgtgcttggtgcatccatcaagtgaaacctgcaacagcatcagattgtctctaagccagctgaatagcaaccctgaactgaggcagcttccacccgtggatgcagaacttgacaacgttaataacgttcttaggacagatttggatggcctggtccaacagggctatcaatcccttaatgatatacctgacagagtacaacgccaaaccacgactgtcgtagcaggtatcaaaagggtcttgaattccattggttcagatatcgacaatgtaactcagcgtcttcctattcaggatatactctcagcattctctgtttatgttaataacactgaaagttacatccacagaaatttacctacattggaagagtatgattcatactggtggctgggtggcctggtcatctgctctctgctgaccctcatcgtgattttttactacctgggcttactgtgtggcgtgtgcggctatgacaggcatgccaccccgaccacccgaggctgtgtctccaacaccggaggcgtcttcctcatggttggagttggattaagtttcctcttttgctggatattgatgatcattgtggttcttacctttgtctttggtgcaaatgtggaaaaactgatctgtgaaccttacacgagcaaggaattattccgggttttggatacaccctacttactaaatgaagactgggaatactatctctctgggaagctatttaataaatcaaaaatgaagctcacttttgaacaagtttacagtgactgcaaaaaaaatagaggcacttacggcactcttcacctgcagaacagcttcaatatcagtgaacatctcaacattaatgagcatactggaagcataagcagtgaattggaaagtctgaaggtaaatcttaatatctttctgttgggtgcagcaggaagaaaaaaccttcaggattttgctgcttgtggaatagacagaatgaattatgacagctacttggctcagactggtaaatcccccgcaggagtgaatcttttatcatttgcatatgatctagaagcaaaagcaaacagtttgcccccaggaaatttgaggaactccctgaaaagagatgcacaaactattaaaacaattcaccagcaacgagtccttcctatagaacaatcactgagcactctataccaaagcgtcaagatacttcaacgcacagggaatggattgttggagagagtaactaggattctagcttctctggattttgctcagaacttcatcacaaacaatacttcctctgttattattgaggaaactaagaagtatgggagaacaataataggatattttgaacattatctgcagtggatcgagttctctatcagtgagaaagtggcatcgtgcaaacctgtggccaccgctctagatactgctgttgatgtctttctgtgtagctacattatcgaccccttgaatttgttttggtttggcataggaaaagctactgtatttttacttccggctctaatttttgcggtaaaactggctaagtactatcgtcgaatggattcggaggacgtgtacgatgatgttgaaactatacccatgaaaaatatggaaaatggtaataatggttatcataaagatcatgtatatggtattcacaatcctgttatgacaagcccatcacaacattgatagctgatgttgaaactgcttgagcatcaggatactcaaagtggaaaggatcacagatttttggtagtttctgggtctacaaggactttccaaatccaggagcaacgccagtggcaacgtagtgactcaggcgggcaccaaggcaacggcaccattggtctctgggtagtgctttaagaatgaacacaatcacgttatagtccatggtccatcactattcaaggatgactccctcccttcctgtctatttttgttttttacttttttacactgagtttctatttagacactacaacatatggggtgtttgttcccattggatgcatttctatcaaaactctatcaaatgtgatggctagattctaacatattgccatgtgtggagtgtgctgaacacacaccagtttacaggaaagatgcattttgtgtacagtaaacggtgtatataccttttgttaccacagagttttttaaacaaatgagtattataggactttcttctaaatgagctaaataagtcaccattgacttcttggtgctgttgaaaataatccattttcactaaaagtgtgtgaaacctacagcatattcttcacgcagagattttcatctattatactttatcaaagattggccatgttccacttggaaatggcatgcaaaagcaatcatagagaaacctgcgtaactccatctgacaaattcaaaagagagagagagatcttgagagagaaatgctgttcgttcaaaagtggagttgttttaacagatgccaattacggtgtacagtttaacagagttttctgttgcattaggataaacattaattggagtgcagctaacatgagtatcatcagactagtatcaagtgttctaaaatgaaatatgagaagatcctgtcacaattcttagatctggtgtccagcatggatgaaacctttgagtttggtccctaaatttgcatgaaagcacaaggtaaatattcatttgcttcaggagtttcatgttggatctgtcattatcaaaagtgatcagcaatgaagaactggtcggacaaaatttaacgttgatgtaatggaattccagatgtaggcattccccccaggtcttttcatgtgcagattgcagttctgattcatttgaataaaaaggaacttggaaaa

SEQ ID NO: 1111 - DNA, 3794 bp, Homo sapiens
ccaagttctacctcatgtttggaggatcttgctagctatggccctcgtactcggctccctgttgctgctggggctgtgcgggaactccttttcaggagggcagccttcatccacagatgctcctaaggcttggaattatgaattgcctgcaacaaattatgagacccaagactcccataaagctggacccattggcattctctttgaactagtgcatatctttctctatgtggtacagccgcgtgatttcccagaagatactttgagaaaattcttacagaaggcatatgaatccaaaattgattatgacaagccagaaactgtaatcttaggtctaaagattgtctactatgaagcagggattattctatgctgtgtcctggggctgctgtttattattctgatgcctctggtggggtatttcttttgtatgtgtcgttgctgtaacaaatgtggtggagaaatgcaccagcgacagaaggaaaatgggcccttcctgaggaaatgctttgcaatctccctgttggtgatttgtataataataagcattggcatcttctatggttttgtggcaaatcaccaggtaagaacccggatcaaaaggagtcggaaactggcagatagcaatttcaaggacttgcgaactctcttgaatgaaactccagagcaaatcaaatatatattggcccagtacaacactaccaaggacaaggcgttcacagatctgaacagtatcaattcagtgctaggaggcggaattcttgaccgactgagacccaacatcatccctgttcttgatgagattaagtccatggcaacagcgatcaaggagaccaaagaggcgttggagaacatgaacagcaccttgaagagcttgcaccaacaaagtacacagcttagcagcagtctgaccagcgtgaaaactagcctgcggtcatctctcaatgaccctctgtgcttggtgcatccatcaagtgaaacctgcaacagcatcagattgtctctaagccagctgaatagcaaccctgaactgaggcagcttccacccgtggatgcagaacttgacaacgttaataacgttcttaggacagatttggatggcctggtccaacagggctatcaatcccttaatgatatacctgacagagtacaacgccaaaccacgactgtcgtagcaggtatcaaaagggtcttgaattccattggttcagatatcgacaatgtaactcagcgtcttcctattcaggatatactctcagcattctctgtttatgttaataacactgaaagttacatccacagaaatttacctacattggaagagtatgattcatactggtggctgggtggcctggtcatctgctctctgctgaccctcatcgtgattttttactacctgggcttactgtgtggcgtgtgcggctatgacaggcatgccaccccgaccacccgaggctgtgtctccaacaccggaggcgtcttcctcatggttggagttggattaagtttcctcttttgctggatattgatgatcattgtggttcttacctttgtctttggtgcaaatgtggaaaaactgatctgtgaaccttacacgagcaaggaattattccgggttttggatacaccctacttactaaatgaagactgggaatactatctctctgggaagctatttaataaatcaaaaatgaagctcacttttgaacaagtttacagtgactgcaaaaaaaatagaggcacttacggcactcttcacctgcagaacagcttcaatatcagtgaacatctcaacattaatgagcatactggaagcataagcagtgaattggaaagtctgaaggtaaatcttaatatctttctgttgggtgcagcaggaagaaaaaaccttcaggattttgctgcttgtggaatagacagaatgaattatgacagctacttggctcagactggtaaatcccccgcaggagtgaatcttttatcatttgcatatgatctagaagcaaaagcaaacagtttgcccccaggaaatttgaggaactccctgaaaagagatgcacaaactattaaaacaattcaccagcaacgagtccttcctatagaacaatcactgagcactctataccaaagcgtcaagatacttcaacgcacagggaatggattgttggagagagtaactaggattctagcttctctggattttgctcagaacttcatcacaaacaatacttcctctgttattattgaggaaactaagaagtatgggagaacaataataggatattttgaacattatctgcagtggatcgagttctctatcagtgagaaagtggcatcgtgcaaacctgtggccaccgctctagatactgctgttgatgtctttctgtgtagctacattatcgaccccttgaatttgttttggtttggcataggaaaagctactgtatttttacttccggctctaatttttgcggtaaaactggctaagtactatcgtcgaatggattcggaggacgtgtacgatgatgttgaaactatacccatgaaaaatatggaaaatggtaataatggttatcataaagatcatgtatatggtattcacaatcctgttatgacaagcccatcacaacattgatagctgatgttgaaactgcttgagcatcaggatactcaaagtggaaaggatcacagatttttggtagtttctgggtctacaaggactttccaaatccaggagcaacgccagtggcaacgtagtgactcaggcgggcaccaaggcaacggcaccattggtctctgggtagtgctttaagaatgaacacaatcacgttatagtccatggtccatcactattcaaggatgactccctcccttcctgtctatttttgttttttacttttttacactgagtttctatttagacactacaacatatggggtgtttgttcccattggatgcatttctatcaaaactctatcaaatgtgatggctagattctaacatattgccatgtgtggagtgtgctgaacacacaccagtttacaggaaagatgcattttgtgtacagtaaacggtgtatataccttttgttaccacagagttttttaaacaaatgagtattataggactttcttctaaatgagctaaataagtcaccattgacttcttggtgctgttgaaaataatccattttcactaaaagtgtgtgaaacctacagcatattcttcacgcagagattttcatctattatactttatcaaagattggccatgttccacttggaaatggcatgcaaaagccatcatagagaaacctgcgtaactccatctgacaaattcaaaagagagagagagatcttgagagagaaatgctgttcgttcaaaagtggagttgttttaacagatgccaattacggtgtacagtttaacagagttttctgttgcattaggataaacattaattggagtgcagctaacatgagtatcatcagactagtatcaagtgttctaaaatgaaatatgagaagatcctgtcacaattcttagatctggtgtccagcatggatgaaacctttgagtttggtccctaaatttgcatgaaagcacaaggtaaatattcatttgcttcaggagtttcatgttggatctgtcattatcaaaagtgatcagcaatgaagaactggtcggacaaaatttaacgttgatgtaatggaattccagatgtaggcattccccccaggtcttttcatgtgcagattgcagttctgattcatttgaataaaaaggaacttgg

SEQ ID NO: 1112 - DNA, 2512 bp, Homo sapiens
ggggcgggtccagtcccgggcgggccgtcgcgggagaggtgctaacggatggaagggttgtttctacctgttggccattgtggatgatgttgctatgcatattgggaaataacatctgctttgctgccgagctcagaggagaccccagacccctcccgcagccagagggctggagcctgctcagaggtgctttgaagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccatgtgctgcagcatgcggagcccgggaacgcacagagcgtgctggaggccattgacacctactgcgagcagaaggagtgggccatgaacgtgggcgacaagaaaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcatgaaggacaaggtcacccttgtggttggagcgtcccaggacatcatcccccagctgaagaagaagtatgatgtggacacactggacatggtcttcctcgaccactggaaggaccggtacctgccggacacgcttctcttggaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgccccccccggccccctgacatgctaacctctctgaactgcaacactggattgttcttttttaagactcaatcatgacttctttactaacactggctagctatattatcttatatactaatatcatgttttaaaaatataaaatagaaattaagaatctaaatatttagatataactcgacttagtacatccttctcaactgccattcccctgctgcccttgacttgggcaccaaacattcaaagctccccttgacggacgctaacgctaagggcggggcccctagctggctgggttctgggtggcacgcctggcccactggcctcccagccacagtggtgcagaggtcagccctcctgcagctaggccaggggcacctgttagccccatggggacgactgccagcctgggaaacgaagaggagtcagccagcattcacacctttctgaccaagcaggcgctggggacaggtggaccccgcagcagcaccagcccctctgggccccatgtggcacagagtggaagcatctccttccctactccccactgggccttgcttacagaagaggcaatggctcagaccagctcccgcatccctgtagttgcctccctggcccatgagtgaggatgcagtgctggtttctgtccacctacacctagagctgtccccatctcctccaaggggtcagactgctagccacctcagaggctccaagggcccagttcccaggcccaggacaggaatcaaccctgtgctagctgagttcacctgcaccgagaccagcccctagccaagattctactcctgggctcaaggcctggctagcccccagccagcccactcctatggatagacagaccagtgagcccaagtggacaagtttggggccacccagggaccagaaacagagcctctgcaggacacagcagatgggcacctgggaccacctccacccagggccctgccccagacgcgcagaggcccgacacaagggagaagccagccacttgtgccagacctgagtggcagaaagcaaaaagttcctttgctgctttaatttttaaattttcttacaaaaatttaggtgtttaccaatagtcttattttggcttatttttaatgctttttctcagtgtttttcttctgtttctgagtcacgaacagcaggcactgaaagcagtcccccagccactgccgaaggtcagtcccggaggtgctgcccaggctccaggcagatgcggcagccccggccacagccagcatgggctggagaaaggctctctactgcacaggggcctcacgtgactgcagggctctggggaggtggggcacctgtagcctgacccccaccttgctgcttccaaagcttccttgcccagcagcccagtcggcctcctcgggccttctgtcactcgctcacacacagcaccatgtcagtaaacagctaactcaggcctagggagttaggtaggatggggggagtggggtgggggggc

SEQ ID NO: 1113 - DNA, 2688 bp, Homo sapiens
cctggccaccgccgcgcggacaccctcacgaggacaccccggccgcgcggacacctaccgcggggacgccccgaccccatcctacctgctgcgccccgcgccgcgccccgcaccccgcccgccacggcctgcgtccgccaccggaagcgccctcctaatccccgcagcgccaccgccattgccgccatcgtcgtggggcttctggggcagctagggctgcccgccgcgctgcctgcgccggaccggggcgggtccagtcccgggcgggccgtcgcgggagagaaataacatctgctttgctgccgagctcagaggagaccccagacccctcccgcagccagagggctggagcctgctcagaggtgctttgaagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccatgtgctgcagcatgcggagcccgggaacgcacagagcgtgctggaggccattgacacctactgcgagcagaaggagtgggccatgaacgtgggcgacaagaaaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcatgaaggacaaggtcacccttgtggttggagcgtcccaggacatcatcccccagctgaagaagaagtatgatgtggacacactggacatggtcttcctcgaccactggaaggaccggtacctgccggacacgcttctcttggaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgccccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaagaatctaaatatttagatataactcgacttagtacatccttctcaactgccattcccctgctgcccttgacttgggcaccaaacattcaaagctccccttgacggacgctaacgctaagggcggggcccctagctggctgggttctgggtggcacgcctggcccactggcctcccagccacagtggtgcagaggtcagccctcctgcagctaggccaggggcacctgttagccccatggggacgactgccagcctgggaaacgaagaggagtcagccagcattcacacctttctgaccaagcaggcgctggggacaggtggaccccgcagcagcaccagcccctctgggccccatgtggcacagagtggaagcatctccttccctactccccactgggccttgcttacagaagaggcaatggctcagaccagctcccgcatccctgtagttgcctccctggcccatgagtgaggatgcagtgctggtttctgtccacctacacctagagctgtccccatctcctccaaggggtcagactgctagccacctcagaggctccaagggcccagttcccaggcccaggacaggaatcaaccctgtgctagctgagttcacctgcaccgagaccagcccctagccaagattctactcctgggctcaaggcctggctagcccccagccagcccactcctatggatagacagaccagtgagcccaagtggacaagtttggggccacccagggaccagaaacagagcctctgcaggacacagcagatgggcacctgggaccacctccacccagggccctgccccagacgcgcagaggcccgacacaagggagaagccagccacttgtgccagacctgagtggcagaaagcaaaaagttcctttgctgctttaatttttaaattttcttacaaaaatttaggtgtttaccaatagtcttattttggcttatttttaatgctttttctcagtgtttttcttctgtttctgagtcacgaacagcaggcactgaaagcagtcccccagccactgccgaaggtcagtcccggaggtgctgcccaggctccaggcagatgcggcagccccggccacagccagcatgggctggagaaaggctctctactgcacaggggcctcacgtgactgcagggctctggggaggtggggcacctgtagcctgacccccaccttgctgcttccaaagcttccttgcccag

SEQ ID NO: 1114 - DNA, 1289 bp, Homo sapiens
caccgccattgccgccatcgtcgtggggcttctggggcagctagggctgcccgccgcgctgcctgcgccggaccggggcgggtccagtcccgggcgggccgtcgcgggagagaaataacatctgctttgctgccgagccagaggagaccccagacccctcccgcagccagagggctggagcctgctcagaggtgctttgaagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtcacccttgtggttggagcgtcccaggacatcatcccccagctgaagaagaagtatgatgtggacacactggacatggtcttcctcgaccactggaaggaccggtacctgccggacacgcttctcttggaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgcccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaa

SEQ ID NO: 1115 - DNA, 2805 bp, Homo sapiens
cctggccaccgccgcgcggacaccctcacgaggacaccccggccgcgcggacacctaccgcggggacgccccgaccccatcctacctgctgcgccccgcgccgcgccccgcaccccgcccgccacggcctgcgtccgccaccggaagcgccctcctaatccccgcagcgccaccgccattgccgccatcgtcgtggggcttctggggcagctagggctgcccgccgcgctgcctgcgccggaccggggcgggtccagtcccgggcgggccgtcgcgggagagaaataacatctgctttgctgccgagctcagaggagaccccagacccctcccgcagccagagggctggagcctgctcagaggtgctttgaagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccatgtgctgcagcatgcggagcccgggaacgcacagagcgtgctggaggccattgacacctactgcgagcagaaggagtgggccatgaacgtgggcgacaagaaaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcatgaaggacaaggtcacccttgtggttggagcgtcccaggacatcatcccccagctgaagaagaagtatgatgtggacacactggacatggtcttcctcgaccactggaaggaccggtacctgccggacacgcttctcttggaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgccccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaagaatctaaatatttagatataactcgacttagtacatccttctcaactgccattcccctgctgcccttgacttgggcaccaaacattcaaagctccccttgacggacgctaacgctaagggcggggcccctagctggctgggttctgggtggcacgcctggcccactggcctcccagccacagtggtgcagaggtcagccctcctgcagctaggccaggggcacctgttagccccatggggacgactgccagcctgggaaacgaagaggagtcagccagcattcacacctttctgaccaagcaggcgctggggacaggtggaccccgcagcagcaccagcccctctgggccccatgtggcacagagtggaagcatctccttccctactccccactgggccttgcttacagaagaggcaatggctcagaccagctcccgcatccctgtagttgcctccctggcccatgagtgaggatgcagtgctggtttctgtccacctacacctagagctgtccccatctcctccaaggggtcagactgctagccacctcagaggctccaagggcccagttcccaggcccaggacaggaatcaaccctgtgctagctgagttcacctgcaccgagaccagcccctagccaagattctactcctgggctcaaggcctggctagcccccagccagcccactcctatggatagacagaccagtgagcccaagtggacaagtttggggccacccagggaccagaaacagagcctctgcaggacacagcagatgggcacctgggaccacctccacccagggccctgccccagacgcgcagaggcccgacacaagggagaagccagccacttgtgccagacctgagtggcagaaagcaaaaagttcctttgctgctttaatttttaaattttcttacaaaaatttaggtgtttaccaatagtcttattttggcttatttttaatgctttttctcagtgtttttcttctgtttctgagtcacgaacagcaggcactgaaagcagtcccccagccactgccgaaggtcagtcccggaggtgctgcccaggctccaggcagatgcggcagccccggccacagccagcatgggctggagaaaggctctctactgcacaggggcctcacgtgactgcagggctctggggaggtggggcacctgtagcctgacccccaccttgctgcttccaaagcttccttgcccagcagcccagtcggcctcctcgggccttctgtcactcgctcacacacagcaccatgtcagtaaacagctaactcaggcctagggagttaggtaggatggggggagtggggtgggggggc

SEQ ID NO: 1116 - DNA, 1067 bp, Homo sapiens
gctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtcacccttgtggttggagcgtcccaggacatcatcccccagctgaagaagaagtatgatgtggacacactggacatggtcttcctcgaccactggaaggaccggtacctgccggacacgcttctcttggaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgcccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaa

SEQ ID NO: 1117 - DNA, 6533 bp, Homo sapiens
ggttctgcgggttggcgctgagtttggaagtcgcgcgggaccccttttatagcagcgtgggcgacgtgccacacgggtgtcccagcccaggggctggtctgagctggaagaggttatgcaaataagggccccacctccacggcaggagggtgagccctaggtccagatgctcacactggcgcaggtctgtcctgagccgacacctgcacagtggcgagaccaaggacccagagagaaaggtgagagtgcagccggggaggctgaggatcggcggagctggaagagtgagggtgaaggcaagaagtagagcacagaagcaaagattttaagaggaaagaagacatctgaacccaacaccaccctaaaccacaggctgcagggttggcatgctccgtgcaagaccagaggcactgatgctcctgggagctcttctgactggatccctgggtccatcgggcaatcaggacgcactctcactgccctgggaagtgcagcgctatgacggctggtttaacaacctgaggcaccacgagcgtggtgctgttggctgccggttgcagcgccgcgtaccagccaattacgccgacggtgtgtatcaggctctggaggagccgcagctgcccaacccgcgccggctcagcaacgcagccacgcggggcatagccggcctgccgtcgctccacaaccgcaccgtactgggggtcttctttggctaccatgttctttccgacgtggtgagcgtggaaacgcccggttgccccgccgagttcctcaacatccgcatcccacctggagaccccgtgttcgaccccgaccagcgcggggacgtggtgctgcccttccagaggagccgctgggaccccgagaccggacggagtcccagcaacccccgggacctggccaaccaggtgacgggctggctggacggcagcgccatctatggctcctcgcactcctggagcgacgcgctgcggagcttctcggggggacagctggcgtcggggcccgaccccgctttcccccgagactcgcagaaccccctgctcatgtgggcggcgcccgaccccgccaccgggcagaacgggccccgggggctgtacgccttcggggcagagagagggaaccgggaacccttcctgcaggcgctgggcctgctctggttccgctaccacaacctgtgggcgcagaggctggcccgccagcacccagactgggaggacgaggagctgttccagcacgcacgcaagagggtcatcgccacctaccagaacatcgctgtgtatgagtggctgcccagcttcctgcagaaaacactcccggagtatacaggataccgtcctttcctagaccccagcatctccccggaatttgtggtggcctctgagcagttcttctctaccatggtgccccctggtgtctacatgagaaatgccagctgtcatttccggaaggtcctgaacaagggttttcaaagctcccaagctctcagggtctgcaacaactactggattcgggagaaccccaatctgaacagtacccaggaggtgaatgagctgctgctgggaatggcctcccagatttcggagttggaggacaacatagtggttgaagatctgagggattactggcctggccctggcaaattctcccgtacagactatgtggccagcagcatccaacgtggccgagatatggggctgcccagctatagccaggccctgctggcctttgggctggacatcccaaggaactggagtgatctcaaccctaatgtggacccccaggtgctggaggccacagctgccctgtacaaccaggacctatcccagctagagctgctccttggcgggctcctggagagccatggggaccctggacccctgttcagtgccattgtcctcgaccagtttgtacggctgcgggatggtgaccgctactggtttgagaacaccaggaatgggctgttctccaagaaggagattgaagacatccgaaataccaccctgcgggacgtgctggtcgctgttatcaacattgaccccagtgccctgcagcccaatgtctttgtctggcataaaggtgcaccctgccctcaacctaagcagctcacaactgacggcctgccccagtgtgcacccctgactgtgcttgacttctttgaaggcagcagccctggttttgccatcaccatcattgctctctgctgccttcccttagtgagtctgcttctctctggagtggtggcctatttccggggccgagaacacaagaagctacaaaagaaactcaaagagagcgtgaagaaggaagcagccaaagatggagtgccagcgatggagtggccaggccccaaggagaggagcagtcccatcatcatccagctgctgtcagacaggtgtctgcaggtcctgaacaggcatctcactgtgctccgtgtggtccagctgcagcctctgcagcaggtcaacctcatcctgtccaacaaccgaggatgccgcaccctgctgctcaagatccctaaggagtatgacctggtgctgctgtttagttctgaagaggaacggggcgcctttgtgcagcagctatgggacttctgcgtgcgctgggctctgggcctccatgtggctgagatgagcgagaaggagctatttaggaaggctgtgacaaagcagcagcgggaacgcatcctggagatcttcttcagacacctttttgctcaggtgctggacatcaaccaggccgacgcagggaccctgcccctggactcctcccagaaggtgcgggaggccctgacctgcgagctgagcagggccgagtttgccgagtccctgggcctcaagccccaggacatgtttgtggagtccatgttctctctggctgacaaggatggcaatggctacctgtccttccgagagttcctggacatcctggtggtcttcatgaaaggctccccagaggataagtcccgtctaatgtttaccatgtatgacctggatgagaatggcttcctctccaaggacgaattcttcaccatgatgcgatccttcatcgagatctccaacaactgcctgtccaaggcccagctggccgaggtggtggagtctatgttccgggagtcgggattccaggacaaggaggagctgacatgggaggattttcacttcatgctgcgggaccatgacagcgagctccgcttcacgcagctctgtgtcaaaggtggaggtggaggtggaaatggtattagagatatctttaaacaaaacatcagctgtcgagtctcgttcatcactcggacacctggggagcgctcccacccccagggactggggccccctgccccagaagccccagagctgggaggccctggactgaagaagaggtttggcaaaaaggcagcagtgcccactccccggctgtacacagaggcgctgcaagagaagatgcagcgaggcttcctagcccaaaagctgcagcagtacaagcgcttcgtggagaactaccggaggcacatcgtgtgtgtggcaatcttctcggccatctgtgttggcgtgtttgcagatcgtgcttactactatggctttgccttgccaccctcggacattgcacagaccaccctcgtgggcatcatcctgtcacgaggcacggcggccagcgtctccttcatgttctcttatatcttgctcaccatgtgccgcaacctcataaccttcctgcgagagactttcctcaaccgctatgtgccttttgatgccgcagtggacttccaccgctggatcgccatggctgctgttgtcctggccattttgcacagtgctggccacgcagtcaatgtctacatcttctcagtcagcccactcagcctgctggcctgcatattccccaacgtctttgtgaatgatgggtccaagcttccccagaagttctattggtggttcttccagaccgtcccaggtatgacaggtgtgcttctgctcctggtcctggccatcatgtatgtcttcgcctcccaccacttccgccgccgcagcttccggggcttctggctgacccaccacctctacatcctgctctatgccctgctcatcatccatggcagctatgctctgatccagctgcccactttccacatctacttcctggtcccggcaatcatctatggaggtgacaagctggtgagcctgagccggaagaaggtggagatcagcgtggtgaaggcggagctgctgccctcaggagtgacctacctgcaattccagaggccccaaggctttgagtacaagtcaggacagtgggtgcggatcgcctgcctggctctggggaccaccgagtaccaccccttcacactgacctccgcgccccatgaggacacactcagcctgcacatccgggcagtggggccctggaccactcgcctcagggagatctactcatccccaaagggcaatggctgtgctggatacccaaagctgtaccttgatggaccgtttggagagggccatcaggagtggcataaatttgaggtgtcagtgttggtgggagggggcattggggtcaccccctttgcctccatcctcaaagacctggtcttcaagtcatccttgggcagccaaatgctgtgtaagaagatctacttcatctgggtgacacggacccagcgtcagtttgagtggctggctgacatcatccaagaggtggaggagaacgaccaccaggacctggtgtctgtgcacatttatgtcacccagctggctgagaagttcgacctcaggaccaccatgctatacatctgcgagcggcacttccagaaagtgctgaaccggagtctgttcacgggcctgcgctccatcacccactttggccgtccccccttcgagcccttcttcaactccctgcaggaggtccacccacaggtgcgcaagatcggggtgttcagctgcggccctccaggaatgaccaagaatgtagagaaggcctgtcagctcgtcaacaggcaggaccgagcccacttcatgcaccactatgagaacttctgagcctgtcctccctggctgctgcttccagtatcctgccttctcttctgtgcacctaagttgcccagccctgctggcaatctctccatcagaatccaccttaggcctcagctggagggctgcagagcccctcccaatattgggagaatattgacccagacaattatacaaatgagaaaaggcaggagactatgttctacaattgcagtgcatgatgattataagtccacctgtttatcaacggcaccattcctgcagccctccagacttcctgcccttagcaagtgcgcaaccagtcaggatctcccaaagaagataaagaccactcctcaccccagctcaagccatggcaggcgtggcaagcaaagtggggaggagacagtccctgcttgtgacaagtgtggaggtgaaaaggtacaatagtgcttgtctccgatagctccccacatctctaattgacttccacaaaatcgatgcgttgctttggtatttgcttggactgacatttgagggaggaggaggctgggatcctctggctgagaatctcctcagagcccagtgcagaagctgtgatgcttagaacctggacagcccgactgcctcaactctgtctccaggtctattccctccagctccaaaaggagcagccctacttctaccccttcccgtccccaaagtgtcagcaactttgaggagggcaccaggaaacaaagatgcctccccagccctgatattcttgatgtcaccagtgatacccactgccctgacccctgggcaggcccctctctgcatctactggagtggtccctgggctctggggctgaaggattccagcctctctgccagatattcagtactcgatctcaattcccctcttccacaagagttgggtgaccagctgtcctagtttgcccaggactctccctgttttagcactgaaagtctcttgccccaggaaaccccatcagtcccaggcagattgggacagctggtcaccttacgcaagagccaggctgaaacatcccctccatactcagctctttaacttttcttttcctttttcatcgggctctttcctaaaaagctgagctgtaaaatattttacatcgaggtataataaataatcatgtacatgttttaccaccacccaggtcaagacatagaatgtttcaacatttccatcaccccagaaactccccttgtacccccttccacttcgtctcccctagctcctagaagcaaccactgatgtgatttctaccaaatccagttttggtcctactaaatatactcttttgagactggcctcttttactcaccataatgcctttgtaattcatccatgctgttgtgtgtatcagcagtttgttccttttcattgctgagtagtattctattgtagagatgtaccacagtttgtttattcttctgttgatggacgtttgggttgtttctaattttgaatgattataaataaaaattctgtgagtgttcttgtaccta

SEQ ID NO: 1118 - DNA, 2145 bp, Homo sapiens
tgaccgtttccgcttccgtccacttggcgagtgagacgctgatgggaggatggacatactggtgtctgagtgctccgcgcggctgctgcagcaggaagaagagattaaatctctgactgctgaaattgaccggttgaaaaactgtggctgtttaggagcttctccaaatttggagcagttacaagaagaaaatttaaaattaaagtatcgactgaatattcttcgaaagagtcttcaggcagaaaggaacaaaccaactaaaaatatgattaacattattagccgcctacaagaggtctttggtcatgcaattaaggctgcatatccagatttggaaaatcctcctctgctagtgacaccaagtcagcaggccaagtttggggactatcagtgtaatagtgctatgggtatttctcagatgctcaaaaccaaggaacagaaagttaatccaagagaaattgctgaaaacattaccaaacacctcccagacaatgaatgtattgaaaaagttgaaattgctggtcctggttttattaatgtccacttaagaaaggattttgtatcagaacaattgaccagtcttctagtgaatggagttcaactacctgctctgggagagaataaaaaggttatagttgacttttcctcccctaatatagctaaagagatgcatgtaggccacctgaggtcaactatcataggagagagtataagccgcctctttgaatttgcagggtatgacgtgctcaggttaaatcatgtaggagactgggggacccagtttggcatgctcatcgctcacctgcaagacaaatttccagattatctaacagtttcacctcctattggggatcttcaggtcttttataaggaatctaagaagaggtttgatactgaggaggaatttaagaagcgagcatatcagtgtgtagttctgctccagggtaaaaacccagatattacaaaagcttggaagcttatctgtgatgtctcccgccaagagttaaataaaatctatgatgcattggacgtctctttaatagagagaggggaatccttctatcaagataggatgaatgatattgtaaaggaatttgaagatagaggatttgtgcaggtggatgatggcagaaagattgtatttgtcccagggtgttccataccattaaccatagtaaaatcagatggaggttatacctatgatacatctgacctggctgctattaaacaaagactatttgaggaaaaagcagatatgattatctatgttgtggacaatggacaatctgtgcacttccagacaatatttgctgctgctcaaatgattggttggtatgaccctaaagtaactcgagtcttccatgctggatttggtgtggtgctaggggaagacaagaaaaagtttaaaacacgttcgggtgaaacagtgcgcctcatggatcttctgggagaaggactaaaacgatccatggacaagttgaaggaaaaagaaagagacaaggtcttaactgcagaggaattgaatgctgctcagacatccgttgcatatggctgcatcaaatatgctgacctttcccataaccggttgaatgactacatcttctcctttgacaaaatgctagatgacagaggaaatacagctgcttacttgttgtatgccttcactagaatcaggtctattgcacgtctggccaatattgatgaagaaatgctccaaaaagctgctcgagaaaccaagattcttttggatcatgagaaggaatggaaactaggccggtgcattttacggttccctgagattctgcaaaagattttagatgacttatttctccacactctctgtgattatatatatgagctggcaactgctttcacagagttctatgatagctgctactgtgtggagaaagatagacagactggaaaaatattgaaggtgaacatgtggcgtatgctgctatgtgaagcagtagctgctgtcatggccaaggggtttgatatcctgggaataaaacctgtccaaaggatgtaatccttcataggtttgaacactgtgtgtttttaccaaagtggccattggcactgtttgcttttttacaatcatgtggacacaagcataagtaaagaaaatttgtcaaccaggca

SEQ ID NO: 1119 - DNA, 2154 bp, Homo sapiens
tccgcttccgtccacttggcgagtgagacgctgatgggaggatggacgtactggtgtctgagtgctccgcgcggctgctgcagcaggaagaagagattaaatctctgactgctgaaattgaccggttgaaaaactgtggctgtttaggagcttctccaaatttggagcagttacaagaagaaaatttaaaattaaagtatcgactgaatattcttcgaaagagtcttcaggcagaaaggaacaaaccaactaaaaatatgattaacattattagccgcctacaagaggtctttggtcatgcaattaaggctgcatatccagatttggaaaatcctcctctgctagtgacaccaagtcagcaggccaagtttggggactatcagtgtaatagtgctatgggtatttctcagatgctcaaaaccaaggaacagaaagttaatccaagagaaattgctgaaaacattaccaaacacctcccagacaatgaatgtattgaaaaagttgaaattgctggtcctggttttattaatgtccacttaagaaaggattttgtatcagaacaattgaccagtcttctagtgaatggagttcaactacctgctctgggagagaataaaaaggttatagttgacttttcctcccctaatatagctaaagagatgcatgtaggccacctgaggtcaactatcataggagagagtataagccgcctctttgaatttgcagggtatgacgtgctcaggttaaatcatgtaggagactgggggacccagtttggcatgctcatcgctcacctgcaagacaaatttccagattatctaacagtttcacctcctattggggatcttcaggtcttttataaggaatctaagaagaggtttgatactgaggaggaatttaagaagcgagcatatcagtgtgtagttctgctccagggtaaaaacccagatattacaaaagcttggaagcttatctgtgatgtctcccgccaagagttaaataaaatctatgatgcattggacgtctctttaatagagagaggggaatccttctatcaagataggatgaatgatattgtaaaggaatttgaagatagaggatttgtgcaggtggatgatggcagaaagattgtatttgtcccagggtgttccataccattaaccatagtaaaatcagatggaggttatacctatgatacatctgacctggctgctattaaacaaagactatttgaggaaaaagcagatatgattatctatgttgtggacaatggacaatctgtgcacttccagacaatatttgctgctgctcaaatgattggttggtatgaccctaaagtaactcgagtcttccatgctggatttggtgtggtgctaggggaagacaagaaaaagtttaaaacacgttcgggtgaaacagtgcgcctcatggatcttctgggagaaggactaaaacgatccatggacaagttgaaggaaaaagaaagagacaaggtcttaactgcagaggaattgaatgctgctcagacatccgttgcgtatggctgcatcaaatatgctgacctttcccataaccggttgaatgactacatcttctcctttgacaaaatgctagatgacagaggaaatacagctgcttacttgttgtatgccttcactagaatcaggtctattgcacgtctggccaatattgatgaagaaatgctccaaaaagctgctcgagaaaccaagattcttttggatcatgagaaggaatggaaactaggccggtgcattttacggttccctgagattctgcaaaagattttagatgacttatttctccacactctctgtgattatatatatgagctggcaactgctttcacagagttctatgatagctgctactgtgtggagaaagatagacagactggaaaaatattgaaggtgaacatgtggcgtatgctgctatgtgaagcagtagctgctgtcatggccaaggggtttgatatcctgggaataaaacctgtccaaaggatgtaatccttcataggtttgaacactgtgtgtttttaccaaagtggccattggcactgtttgcttttttacaatcatgtggacacaagcataagtaaagaaaatttgtcaaccaggcaaaaaaaaaaaaaaaaaa

SEQ ID NO: 1120 - DNA, 4080 bp, Homo sapiens
ttgattctgggcactgatagcagtacttggctgcagacactcgttccaaacaggccccatttttccatctctgctgctgttattaggggagcccttagactctcttgcagcgccggaataggcggtcaagacgtgtgttaatattgcaacagcaaatataatgaatctgcagttggggacgctgaggccggagtggtggatgaaaggtggccggagccttttccacgggtccaaaccacctgttacaggagaaggcgagcggcctcgctaagcaactggacgttccgcgggcggggcggggccggggcccgagtccgctcggaaactttcgctgtgggcgagccggacccgccttctggcccctcgggcccaaccacgcaggggtagtgccgggccgcagctaggcgaggcgcaccgtgattggcggagatgtggagtgattggcggctacaccggccactcagcaggccgagctggcgccgcatccggggggccgcgtctggagtggagggaggccgaaggccccgcccctgccccgccccctcgtgcagaaggccgcgctagccggctcttcagcagcgagtgcagattgctcccccgcggccgcaggatggactccaacactgctccgctgggcccctcctgcccacagcccccgccagcaccgcagccccaggcgcgttcccgactcaatgccacagcctcgttggagcaggagaggagcgaaaggccccgagcacccggaccccaggctggccctggccctggtgttagagacgcagcggcccccgctgaaccccaggcccagcataccaggagccgggaaagagcagacggcaccgggcctacaaagggagacatggaaatcccctttgaagaagtcctggagagggccaaggccggggaccccaaggcacagactgaggtggggaagcactacctgcagttggccggcgacacggatgaagaactcaacagctgcaccgctgtggactggctggtcctcgccgcgaagcagggccgtcgcgaggctgtgaagctgcttcgccggtgcttggcggacagaagaggcatcacgtccgagaacgaacgggaggtgaggcagctctcctccgagaccgacctggagagggccgtgcgcaaggcagccctggtcatgtactggaagctcaaccccaagaagaagaagcaggtggccgtggcggagctgctggagaatgtcggccaggtcaacgagcacgatggaggggcgcagccaggccccgtgcccaagtccctgcagaagcagaggcgcatgctggagcgcctggtcagcagcgagtccaagaactacatcgcgctggatgactttgtggagatcactaagaagtacgccaagggcgtcatccccagcagcctgttcctgcaggacgacgaagatgatgacgagctggcggggaagagccctgaggacctgccactgcgtctgaaggtggtcaagtaccccctgcacgccatcatggagatcaaggagtacctgattgacatggcctccagggcaggcatgcactggctgtccaccatcatccccacgcaccacatcaacgcgctcatcttcttcttcatcatcagcaacctcaccatcgacttcttcgccttcttcatcccgctggtcatcttctacctgtccttcatctccatggtgatctgcaccctcaaggtgttccaggacagcaaggcctgggagaacttccgcaccctcaccgacctgctgctgcgcttcgagcccaacctggatgtggagcaggccgaggttaacttcggctggaaccacctggagccctatgcccatttcctgctctctgtcttcttcgtcatcttctccttccccatcgccagcaaggactgcatcccctgctcggagctggctgtcatcaccggcttctttaccgtgaccagctacctgagcctgagcacccatgcagagccctacacgcgcagggccctggccaccgaggtcaccgccggcctgctatcgctgctgccctccatgcccttgaattggccctacctgaaggtccttggccagaccttcatcaccgtgcctgtcggccacctggtcgtcctcaacgtcagcgtcccgtgcctgctctatgtctacctgctctatctcttcttccgcatggcacagctgaggaatttcaagggcacctactgctaccttgtgccctacctggtgtgcttcatgtggtgtgagctctccgtggtcatcctgctggagtccaccggcctggggctgctccgcgcctccatcggctacttcctcttcctctttgccctccccatcctggtggccggcctggccctggtgggcgtgctgcagttcgcccggtggttcacgtctctggagctcaccaagatcgcagtcaccgtggcggtctgtagtgtgcccctgctgttgcactggtggaccaaggccagcttctctgtggtggggatggtgaagtccctgacgcggagctccatggtcaagctcatcctggtgtggctcacggccatcgtgctgttctgctggttctatgtgtaccgctcagagggcatgaaggtctacaactccacactgacctggcagcagtatggtgcgctgtgcgggccacgcgcctggaaggagaccaacatggcgcgcacccagatcctctgcagccacctggagggccacagggtcacgtggaccggccgcttcaagtacgtccgcgtgactgacatcgacaacagcgccgagtctgccatcaacatgctcccgttcttcatcggcgactggatgcgctgcctctacggcgaggcctaccctgcctgcagccctggcaacacctccacggccgaggaggagctctgtcgccttaagctgctggccaagcacccctgccacatcaagaagttcgaccgctacaagtttgagattaccgtgggcatgccattcagcagcggcgctgacggctcgcgcagccgcgaggaggacgacgtcaccaaggacatcgtgctgcgggccagcagcgagttcaaaagcgtgctgctcagcctgcgccagggcagcctcatcgagttcagcaccatcctggagggccgcctgggcagcaagtggcctgtcttcgagctcaaggccatcagctgcctcaactgcatggcccagctctcgcccaccaggcggcacgtgaagatcgagcacgactggcgcagcaccgtgcatggcgccgtgaagttcgccttcgacttctttttcttcccattcctgtcggcggcctgaggatggtccgccacgaggagcttccagtgcatgttgccatgaggcctttccccagtgtggccccagcccgacaggcatgcaccagtgccgcctgtgcccacgtgtgcagactgtggctgcagagaccttgcgaccatgtgtagattgcgtggaccccgacaaagggaaggctgctgtgtagctctgtccactctgaataccaagtgtgttgggaattgcatgccatctccaccctgagcctgacctttctgagtgacatgggtgtgccaggctagactaggaggttccggtgtctggaaaagcactttacagatgagattccctctcctcccccaccttcaagcaccctgttccctctttctttcttttgtgttggatttgtttaaaaaccaaataagcatctgtgtaacctccacagtagcatttcttatttgtttggtcactgctacaccttagcagctcttcccctttcctgggggatgtgcacggcagcttgagcctgtcacgtggtcaaggcccggccccatcagaggctgggggaggcggcacattggcagtgtgtcacactgagctgggcaccacaggctgcctcatgaccctcctgtccagcaggtagtgggtgaatgtgtgaaggtcttgcctgaatccatcaggacttgggaaacagagaaccctgtgggggtggctgtgggggaggtccctgccagtgtttagaagagcctgactgtgttcagtgccttggagcagaaagccagggtcctgagtggctgaaataaaagcctctggtggaacctgca

SEQ ID NO: 1121 - DNA, 3587 bp, Homo sapiens
gtgcagaaggccgcgctagccggctcttcagcagcgagtgcagattgctcccccgcggccgcagatctcccgtttgcgccgcgttcagctgctcccgaacaacttttctgccggcccagaggccccagggcgtcgcagcgccgcgtgcggcccactcacgggccggcaggatggactccaacactgctccgctgggcccctcctgcccacagcccccgccagcaccgcagccccaggcgcgttcccgactcaatgccacagcctcgttggagcaggagaggagcgaaaggccccgagcacccggaccccaggctggccctggccctggtgttagagacgcagcggcccccgctgaaccccaggcccagcataccaggagccgggaaagagcagacggcaccgggcctacaaagggagacatggaaatcccctttgaagaagtcctggagagggccaaggccggggaccccaaggcacagactgaggtggggaagcactacctgcagttggccggcgacacggatgaagaactcaacagctgcaccgctgtggactggctggtcctcgccgcgaagcagggccgtcgcgaggctgtgaagctgcttcgccggtgcttggcggacagaagaggcatcacgtccgagaacgaacgggaggtgaggcagctctcctccgagaccgacctggagagggccgtgcgcaaggcagccctggtcatgtactggaagctcaaccccaagaagaagaagcaggtggccgtggcggagctgctggagaatgtcggccaggtcaacgagcacgatggaggggcgcagccaggccccgtgcccaagtccctgcagaagcagaggcgcatgctggagcgcctggtcagcagcgagtccaagaactacatcgcgctggatgactttgtggagatcactaagaagtacgccaagggcgtcatccccagcagcctgttcctgcaggacgacgaagatgatgacgagctggcggggaagagccctgaggacctgccactgcgtctgaaggtggtcaagtaccccctgcacgccatcatggagatcaaggagtacctgattgacatggcctccagggcaggcatgcactggctgtccaccatcatccccacgcaccacatcaacgcgctcatcttcttcttcatcatcagcaacctcaccatcgacttcttcgccttcttcatcccgctggtcatcttctacctgtccttcatctccatggtgatctgcaccctcaaggtgttccaggacagcaaggcctgggagaacttccgcaccctcaccgacctgctgctgcgcttcgagcccaacctggatgtggagcaggccgaggttaacttcggctggaaccacctggagccctatgcccatttcctgctctctgtcttcttcgtcatcttctccttccccatcgccagcaaggactgcatcccctgctcggagctggctgtcatcaccggcttctttaccgtgaccagctacctgagcctgagcacccatgcagagccctacacgcgcagggccctggccaccgaggtcaccgccggcctgctatcgctgctgccctccatgcccttgaattggccctacctgaaggtccttggccagaccttcatcaccgtgcctgtcggccacctggtcgtcctcaacgtcagcgtcccgtgcctgctctatgtctacctgctctatctcttcttccgcatggcacagctgaggaatttcaagggcacctactgctaccttgtgccctacctggtgtgcttcatgtggtgtgagctctccgtggtcatcctgctggagtccaccggcctggggctgctccgcgcctccatcggctacttcctcttcctctttgccctccccatcctggtggccggcctggccctggtgggcgtgctgcagttcgcccggtggttcacgtctctggagctcaccaagatcgcagtcaccgtggcggtctgtagtgtgcccctgctgttgcactggtggaccaaggccagcttctctgtggtggggatggtgaagtccctgacgcggagctccatggtcaagctcatcctggtgtggctcacggccatcgtgctgttctgctggttctatgtgtaccgctcagagggcatgaaggtctacaactccacactgacctggcagcagtatggtgcgctgtgcgggccacgcgcctggaaggagaccaacatggcgcgcacccagatcctctgcagccacctggagggccacagggtcacgtggaccggccgcttcaagtacgtccgcgtgactgacatcgacaacagcgccgagtctgccatcaacatgctcccgttcttcatcggcgactggatgcgctgcctctacggcgaggcctaccctgcctgcagccctggcaacacctccacggccgaggaggagctctgtcgccttaagctgctggccaagcacccctgccacatcaagaagttcgaccgctacaagtttgagattaccgtgggcatgccattcagcagcggcgctgacggctcgcgcagccgcgaggaggacgacgtcaccaaggacatcgtgctgcgggccagcagcgagttcaaaagcgtgctgctcagcctgcgccagggcagcctcatcgagttcagcaccatcctggagggccgcctgggcagcaagtggcctgtcttcgagctcaaggccatcagctgcctcaactgcatggcccagctctcgcccaccaggcggcacgtgaagatcgagcacgactggcgcagcaccgtgcatggcgccgtgaagttcgccttcgacttctttttcttcccattcctgtcggcggcctgaggatggtccgccacgaggagcttccagtgcatgtttgccgcctgtgcccacgtgtgcagactgtggctgcagagaccttgcgaccatgtgtagattgcgtggaccccgacaaagggaaggctgctgtgtagctctgtccactctgaataccaagtgtgttgggaattgcatgccatctccaccctgagcctgacctttctgagtgacatgggtgtgccaggctagactaggaggttccggtgtctggaaaagcactttacagatgagattccctctcctcccccaccttcaagcaccctgttccctctttctttcttttgtgttggatttgtttaaaaaccaaataagcatctgtgtaacctccacagtagcatttcttatttgtttggtcactgctacaccttagcagctcttcccctttcctgggggatgtgcacggcagcttgagcctgtcacgtggtcaaggcccggccccatcagaggctgggggaggcggcacattggcagtgtgtcacactgagctgggcaccacaggctgcctcatgaccctcctgtccagcaggtagtgggtgaatgtgtgaaggtcttgcctgaatccatcaggacttgggaaacagagaaccctgtgggggtggctgtgggggaggtccctgccagtgtttagaagagcctgactgtgttcagtgccttggagcagaaagccagggtcctgagtggctgaaataaaagcctctggtggaacct

SEQ ID NO: 1122 - DNA, 3640 bp, Homo sapiens
gtgcagaaggccgcgctagccggctcttcagcagcgagtgcagattgctcccccgcggccgcagatctcccgtttgcgccgcgttcagctgctcccgaacaacttttctgccggcccagaggccccagggcgtcgcagcgccgcgtgcggcccactcacgggccggcaggatggactccaacactgctccgctgggcccctcctgcccacagcccccgccagcaccgcagccccaggcgcgttcccgactcaatgccacagcctcgttggagcaggagaggagcgaaaggccccgagcacccggaccccaggctggccctggccctggtgttagagacgcagcggcccccgctgaaccccaggcccagcataccaggagccgggaaagagcagacggcaccgggcctacaaagggagacatggaaatcccctttgaagaagtcctggagagggccaaggccggggaccccaaggcacagactgaggtggggaagcactacctgcagttggccggcgacacggatgaagaactcaacagctgcaccgctgtggactggctggtcctcgccgcgaagcagggccgtcgcgaggctgtgaagctgcttcgccggtgcttggcggacagaagaggcatcacgtccgagaacgaacgggaggtgaggcagctctcctccgagaccgacctggagagggccgtgcgcaaggcagccctggtcatgtactggaagctcaaccccaagaagaagaagcaggtggccgtggcggagctgctggagaatgtcggccaggtcaacgagcacgatggaggggcgcagccaggccccgtgcccaagtccctgcagaagcagaggcgcatgctggagcgcctggtcagcagcgagtccaagaactacatcgcgctggatgactttgtggagatcactaagaagtacgccaagggcgtcatccccagcagcctgttcctgcaggacgacgaagatgatgacgagctggcggggaagagccctgaggacctgccactgcgtctgaaggtggtcaagtaccccctgcacgccatcatggagatcaaggagtacctgattgacatggcctccagggcaggcatgcactggctgtccaccatcatccccacgcaccacatcaacgcgctcatcttcttcttcatcatcagcaacctcaccatcgacttcttcgccttcttcatcccgctggtcatcttctacctgtccttcatctccatggtgatctgcaccctcaaggtgttccaggacagcaaggcctgggagaacttccgcaccctcaccgacctgctgctgcgcttcgagcccaacctggatgtggagcaggccgaggttaacttcggctggaaccacctggagccctatgcccatttcctgctctctgtcttcttcgtcatcttctccttccccatcgccagcaaggactgcatcccctgctcggagctggctgtcatcaccggcttctttaccgtgaccagctacctgagcctgagcacccatgcagagccctacacgcgcagggccctggccaccgaggtcaccgccggcctgctatcgctgctgccctccatgcccttgaattggccctacctgaaggtccttggccagaccttcatcaccgtgcctgtcggccacctggtcgtcctcaacgtcagcgtcccgtgcctgctctatgtctacctgctctatctcttcttccgcatggcacagctgaggaatttcaagggcacctactgctaccttgtgccctacctggtgtgcttcatgtggtgtgagctctccgtggtcatcctgctggagtccaccggcctggggctgctccgcgcctccatcggctacttcctcttcctctttgccctccccatcctggtggccggcctggccctggtgggcgtgctgcagttcgcccggtggttcacgtctctggagctcaccaagatcgcagtcaccgtggcggtctgtagtgtgcccctgctgttgcactggtggaccaaggccagcttctctgtggtggggatggtgaagtccctgacgcggagctccatggtcaagctcatcctggtgtggctcacggccatcgtgctgttctgctggttctatgtgtaccgctcagagggcatgaaggtctacaactccacactgacctggcagcagtatggtgcgctgtgcgggccacgcgcctggaaggagaccaacatggcgcgcacccagatcctctgcagccacctggagggccacagggtcacgtggaccggccgcttcaagtacgtccgcgtgactgacatcgacaacagcgccgagtctgccatcaacatgctcccgttcttcatcggcgactggatgcgctgcctctacggcgaggcctaccctgcctgcagccctggcaacacctccacggccgaggaggagctctgtcgccttaagctgctggccaagcacccctgccacatcaagaagttcgaccgctacaagtttgagattaccgtgggcatgccattcagcagcggcgctgacggctcgcgcagccgcgaggaggacgacgtcaccaaggacatcgtgctgcgggccagcagcgagttcaaaagcgtgctgctcagcctgcgccagggcagcctcatcgagttcagcaccatcctggagggccgcctgggcagcaagtggcctgtcttcgagctcaaggccatcagctgcctcaactgcatggcccagctctcgcccaccaggcggcacgtgaagatcgagcacgactggcgcagcaccgtgcatggcgccgtgaagttcgccttcgacttctttttcttcccattcctgtcggcggcctgaggatggtccgccacgaggagcttccagtgcatgttgccatgaggcctttccccagtgtggccccagcccgacaggcatgcaccagtgccgcctgtgcccacgtgtgcagactgtggctgcagagaccttgcgaccatgtgtagattgcgtggaccccgacaaagggaaggctgctgtgtagctctgtccactctgaataccaagtgtgttgggaattgcatgccatctccaccctgagcctgacctttctgagtgacatgggtgtgccaggctagactaggaggttccggtgtctggaaaagcactttacagatgagattccctctcctcccccaccttcaagcaccctgttccctctttctttcttttgtgttggatttgtttaaaaaccaaataagcatctgtgtaacctccacagtagcatttcttatttgtttggtcactgctacaccttagcagctcttcccctttcctgggggatgtgcacggcagcttgagcctgtcacgtggtcaaggcccggccccatcagaggctgggggaggcggcacattggcagtgtgtcacactgagctgggcaccacaggctgcctcatgaccctcctgtccagcaggtagtgggtgaatgtgtgaaggtcttgcctgaatccatcaggacttgggaaacagagaaccctgtgggggtggctgtgggggaggtccctgccagtgtttagaagagcctgactgtgttcagtgccttggagcagaaagccagggtcctgagtggctgaaataaaagcctctggtggaacctgca

SEQ ID NO: 1123 - DNA, 3628 bp, Homo sapiens
gcgctagccggctcttcagcagcgagtgcagattgctcccccgcggccgcagatctcccgtttgcgccgcgttcagctgctcccgaacaacttttctgccggcccagaggccccagggcgtcgcagcgccgcgtgcggcccactcacgggccggcaggatggactccaacactgctccgctgggcccctcctgcccacagcccccgccagcaccgcagccccaggcgcgttcccgactcaatgccacagcctcgttggagcaggagaggagcgaaaggccccgagcacccggaccccaggctggccctggccctggtgttagagacgcagcggcccccgctgaaccccaggcccagcataccaggagccgggaaagagcagacggcaccgggcctacaaagggagacatggaaatcccctttgaagaagtcctggagagggccaaggccggggaccccaaggcacagactgaggtggggaagcactacctgcagttggccggcgacacggatgaagaactcaacagctgcaccgctgtggactggctggtcctcgccgcgaagcagggccgtcgcgaggctgtgaagctgcttcgccggtgcttggcggacagaagaggcatcacgtccgagaacgaacgggaggtgaggcagctctcctccgagaccgacctggagagggccgtgcgcaaggcagccctggtcatgtactggaagctcaaccccaagaagaagaagcaggtggccgtggcggagctgctggagaatgtcggccaggtcaacgagcacgatggaggggcgcagccaggccccgtgcccaagtccctgcagaagcagaggcggatgctggagcgcctggtcagcagcgagtccaagaactacatcgcgctggatgactttgtggagatcactaagaagtacgccaagggcgtcatccccagcagcctgttcctgcaggacgacgaagatgatgacgagctggcggggaagagccctgaggacctgccactgcgtctgaaggtggtcaagtaccccctgcacgccatcatggagatcaaggagtacctgattgacatggcctccagggcaggcatgcactggctgtccaccatcatccccacgcaccacatcaacgcgctcatcttcttcttcatcatcagcaacctcaccatcgacttcttcgccttcttcatcccgctggtcatcttctacctgtccttcatctccatggtgatctgcaccctcaaggtgttccaggacagcaaggcctgggagaacttccgcaccctcaccgacctgctgctgcgcttcgagcccaacctggatgtggagcaggccgaggttaacttcggctggaaccacctggagccctatgcccatttcctgctctctgtcttcttcgtcatcttctccttccccatcgccagcaaggactgcatcccctgctcggagctggctgtcatcaccggcttctttaccgtgaccagctacctgagcctgagcacccatgcagagccctacacgcgcagggccctggccaccgaggtcaccgccggcctgctatcgctgctgccctccatgcccttgaattggccctacctgaaggtccttggccagaccttcatcaccgtgcctgtcggccacctggtcgtcctcaatgtcagcgtcccgtgcctgctctatgtctacctgctctatctcttcttccgcatggcacagctgaggaatttcaagggcacctactgctaccttgtgccctacctggtgtgcttcatgtggtgtgagctctccgtggtcatcctgctggagtccaccggcctggggctgctccgcgcctccatcggctacttcctcttcctctttgccctccccatcctggtggccggcctggccctggtgggcgtgctgcagttcgcccggtggttcacgtctctggagctcaccaagatcgcagtcaccgtggcggtctgtagtgtgcccctgctgttgcgctggtggaccaaggccagcttctctgtggtggggatggtgaagtccctgacgcggagctccatggtcaagctcatcctggtgtggctcacggccatcgtgctgttctgctggttctatgtgtaccgctcagagggcatgaaggtctacaactccacactgacctggcagcagtatggtgcgctgtgcgggccacgcgcctggaaggagaccaacatggcgcgcacccagatcctctgcagccacctggagggccacagggtcacgtggaccggccgcttcaagtacgtccgcgtgactgacatcgacaacagcgccgagtctgccatcaacatgctcccgttcttcatcggcgactggatgcgctgcctctacggcgaggcctaccctgcctgcagccctggcaacacctccacggccgaggaggagctctgtcgccttaagctgctggccaagcacccctgccacatcaagaagttcgaccgctacaagtttgagattaccgtgggcatgccattcagcagcggcgctgacggctcgcgcagccgcgaggaggacgacgtcaccaaggacatcgtgctgcgggccagcagcgagttcaagagcgtgctgctcagcctgcgccagggcagcctcatcgagttcagcaccatcctggagggccgcctgggcagcaagtggcctgtcttcgagctcaaggccatcagctgcctcaactgcatggcccagctctcacccaccaggcggcacgtgaagatcgagcacgactggcgcagcaccgtgcatggcgccgtgaagttcgccttcgacttctttttcttcccattcctgtcggcggcctgaggatggtccgccacgaggagcttccagtgcatgttgccatgaggcctttccccagtgtggccccagcccgacaggcatgcaccagtgccgcctgtgcccacgtgtgcagactgtggctgcagagaccttgcgaccatgtgtagattgcgtggaccccgacaaagggaaggctgctgtgtagctctgtccactctgaataccaagtgtgttgggaattgcatgccatctccaccctgagcctgacctttctgagtgacatgggtgtgccaggctagactaggaggttccggtgtctggaaaagcactttacagatgagattccctctcctcccccaccttcaagcaccctgttccctctttctttcttttgtgttggatttgtttaaaaaccaaataagcatctgtgtaacctccacagtagcatttcttatttgtttggtcactgctacaccttagcagctcttcccctttcctgggggatgtgcacggcagcttgagcctgtcacgtggtcaaggcccggccccatcagaggctgggggaggcggcacattggcagtgtgtcacactgagctgggcaccacaggctgcctcatgaccctcctgtccagcaggtagtgggtgaatgtgtgaaggtcttgcctgaatccatcaggacttgggaaacagagaaccctgtgggggcggctgtgggggaggtccctgccagtgtttagaagagcctgactgtgttcagtgccttggagcagaaagccagggtcctgagtggctgaaataaaagcctctggtggaacctgca

SEQ ID NO: 1124 - DNA, 2002 bp, Homo sapiens
cccggctgggcccgagagccagcgggcgggcgggctgcggactctagcggggcctgccgggaaaggggcgggccgagcgcactgggccgaggcggggcgaagtgggggtgcttagtccgttgcggggggcggggtcgcgtctgccgcagcaacggggtgcggcagggtggggaacgcgggagcggggccagctcccaggaaagctggtctgcgagcggcccctgcccggctcccaggtccctgcgcgaccccgcccttcccgagaccccagccgggctgccgcccgcgtcccggaagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcaggtggccaagactaagcagcagattgaggagcagcgggtgcaggtgcaggtggtggagcgggcccagcaggtggcagtgcaggagcaggagatcgcccggcgggagaaggagctggaggcccgggtgcggaagccagcggaagcggagcgctacaagctggagcgcctagccgaggcagagaagtcccaactaattatgcaggcggaggcagaagccgcgtctgtgcggatgcgtggggaagctgaggcctttgccataggggcccgagcccgagccgaggctgagcagatggccaagaaggcagaagccttccagctgtaccaagaggctgctcagctggacatgctgctagagaagctgccccaggtggcagaggagatcagtggtcccttgacttcagccaataagatcacactggtgtccagcggcagtgggaccatgggggcagccaaagtgactggggaagtactggacattctaactcgcctgccagagagtgtggaaagactcacaggcgtgagcatctcccaggtgaatcacaagcctttgagaacagcctgagccttcagccctcacagatgcccagcctcatagctgaagttgcctgaatgatcctcctgttgcatgtaacccactggcctccctgagcatgtccattgacagtgaggtcccacccctcatctctccttgccaaatagtttgtgccttgtcttgaagggggttgctccccttgccaacctcacactgctatgattgccaactccagcggtcccatgtcagccttctgatgatcccactccaccccacctcaacttatttaacttcctaattaaatcagactgtttgagcctgttgtctagaatattttcctgaccaagactgagggatgggctggaggttttcaactttgctacccaaataaattgctgtaagtaagtactaataaaacagaagcaactggaaattaa

SEQ ID NO: 1125 - DNA, 1925 bp, Homo sapiens
cccggctgggcccgagagccagcgggcgggcgggctgcggactctagcggggcctgccgggaaaggggcgggccgagcgcactgggccgaggcggggcgaagtgggggtgcttagtccgcccttcccgagaccccagccgggctgccgcccgcgtcccggaagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcaggtggccaagactaagcagcagattgaggagcagcgggtgcaggtgcaggtggtggagcgggcccagcaggtggcagtgcaggagcaggagatcgcccggcgggagaaggagctggaggcccgggtgcggaagccagcggaagcggagcgctacaagctggagcgcctagccgaggcagagaagtcccaactaattatgcaggcggaggcagaagccgcgtctgtgcggatgcgtggggaagctgaggcctttgccataggggcccgagcccgagccgaggctgagcagatggccaagaaggcagaagccttccagctgtaccaagaggctgctcagctggacatgctgctagagaagctgccccaggtggcagaggagatcagtggtcccttgacttcagccaataagatcacactggtgtccagcggcagtgggaccatgggggcagccaaagtgactggggaagtactggacattctaactcgcctgccagagagtgtggaaagactcacaggcgtgagcatctcccaggtgaggtctcaggttggagctgaggagaattgctaggttcctgtgttgtgtgacacagtatgcctagcatttaaccagcatccaggcctgggagtcattgatgtttattaatcactttctgtgtgccagacacagtgctaagcttctacataaatgagttgttttaaatcaaactaccattagggtatataggattttacaaagtccagaaactcaacatccagcatgttcctactcattctgctagtgcagctggagtgaaatccaggtcgactgtctctgcaacctgtgcttgtggtcaccccactagtatagggaactagttgcagcctattgacagttaattaattctagggcatatcactgcttttctcagcgccccagttaattcacctgtagatcatggtagaagtcagcaaacaggctctggaaccactgttttgttgcgaatcctagctacaatgcctgctagctgtaatcttggacaagtaatc

SEQ ID NO: 1126 - DNA, 1839 bp, Homo sapiens
agcaacggggtgcggcagggtggggaacgcgggagcggggccagctcccaggaaagctggtctgcgagcggcccctgcccggctcccaggtccctgcgcgaccccgcccttcccgagaccccagccgggctgccgcccgcgtcccggaagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcaggtggccaagactaagcagcagattgaggagcagcgggtgcaggtgcaggtggtggagcgggcccagcaggtggcagtgcaggagcaggagatcgcccggcgggagaaggagctggaggcccgggtgcggaagccagcggaagcggagcgctacaagctggagcgcctagccgaggcagagaagtcccaactaattatgcaggcggaggcagaagccgcgtctgtgcggatgcgtggggaagctgaggcctttgccataggggcccgagcccgagccgaggctgagcagatggccaagaaggcagaagccttccagctgtaccaagaggctgctcagctggacatgctgctagagaagctgccccaggtggcagaggagatcagtggtcccttgacttcagccaataagatcacactggtgtccagcggcagtgggaccatgggggcagccaaagtgactggggaagtactggacattctaactcgcctgccagagagtgtggaaagactcacaggcgtgagcatctcccaggtgaatcacaagcctttgagaacagcctgagccttcagccctcacagatgcccagcctcatagctgaagttgcctgaatgatcctcctgttgcatgtaacccactggcctccctgagcatgtccattgacagtgaggtcccacccctcatctctccttgccaaatagtttgtgccttgtcttgaagggggttgctccccttgccaacctcacactgctatgattgccaactccagcggtcccatgtcagccttctgatgatcccactccaccccacctcaacttatttaacttcctaattaaatcagactgtttgagcctgttgtctagaatattttcctgaccaagactgagggatgggctggaggttttcaactttgctacccaaataaattgctgtaagtaagtactaaaaaaaaaaa

SEQ ID NO: 1127 - DNA, 1868 bp, Homo sapiens
cccggctgggcccgagagccagcgggcgggcgggctgcggactctagcggggcctgccgggaaaggggcgggccgagcgcactgggccgaggcggggcgaagtgggggtgcttagtccgcccttcccgagaccccagccgggctgccgcccgcgtcccggaagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcaggtggccaagactaagcagcagattgaggagcagcgggtgcaggtgcaggtggtggagcgggcccagcaggtggcagtgcaggagcaggagatcgcccggcgggagaaggagctggaggcccgggtgcggaagccagcggaagcggagcgctacaagctggagcgcctagccgaggcagagaagtcccaactaattatgcaggcggaggcagaagccgcgtctgtgcggatgcgtggggaagctgaggcctttgccataggggcccgagcccgagccgaggctgagcagatggccaagaaggcagaagccttccagctgtaccaagaggctgctcagctggacatgctgctagagaagctgccccaggtggcagaggagatcagtggtcccttgacttcagccaataagatcacactggtgtccagcggcagtgggaccatgggggcagccaaagtgactggggaagtactggacattctaactcgcctgccagagagtgtggaaagactcacaggcgtgagcatctcccaggtgaatcacaagcctttgagaacagcctgagccttcagccctcacagatgcccagcctcatagctgaagttgcctgaatgatcctcctgttgcatgtaacccactggcctccctgagcatgtccattgacagtgaggtcccacccctcatctctccttgccaaatagtttgtgccttgtcttgaagggggttgctccccttgccaacctcacactgctatgattgccaactccagcggtcccatgtcagccttctgatgatcccactccaccccacctcaacttatttaacttcctaattaaatcagactgtttgagcctgttgtctagaatattttcctgaccaagactgagggatgggctggaggttttcaactttgctacccaaataaattgctgtaagtaagtactaataaaacagaagcaactggaaattaa

SEQ ID NO: 1128 - DNA, 2208 bp, Homo sapiens
gggcaccgtaaccagcgccgcggacaccggcaccggcgccacggactccgcaggaccccgcgcccgccgccgccgctatgctggggctgctggtggcgttgctggccctggggctcgctgtctttgcgctgctggacgtctggtacctggtgcgccttccgtgcgccgtgctgcgcgcgcgcctgctgcagccgcgcgtccgtgacctgctagctgagcagcgcttcccgggccgcgtgctgccctcggacttggacctgctgttgcacatgaacaacgcgcgctacctgcgcgaggccgactttgcgcgcgtcgcgcacctgacccgctgcggggtgctcggggcgctgagggagttgcgggcgcacacggtgctggcggcctcgtgcgcgcgccaccgccgctcgctgcgcctgctggagcccttcgaggtgcgcacccgcctgctgggctgggacgaccgcgcgttctacctggaggcgcgctttgtcagcctgcgggacggtttcgtgtgcgcgctgctgcgcttccggcagcacctgctgggcacctcacccgagcgcgtcgtgcagcacctgtgccagcgcagggtggagccccctgagctgcccgctgatctgcagcactggatctcctacaacgaggccagcagccagctgctccgcatggagagtgggctcagtgatgtcaccaaggaccagtgaccgccaccttcacaccgtctgccctggccaccatcctgggcctgggggctgcccacagatgggcagtctcagccatactctgttccagctggagtagcctcctgaccagcctggcccaccctgctccacccactgggcccccccagttattgatacccctctgtgctgggctccacgctaggcagaaggaggagtggcattggcatcctgacccagctctgccctcaaggtggggatggatgggcaaaggagagtcctgcctggccctacgatgaggccactcatgtgggcctaggtaggggaggatggtgcctggagcagagggacccacaagtgcctcccgagcctagatcctggctcggaccactgcaagggccgaggcagggccagaccagagcatcctgggtacaggcctgggctctccagggcctgggcctgattcaggtgcagtgggcactcctgaagggtcagagcggcatctgccaggcagcccctctggcttccgctgaggtggttgcaggcctggggcagagcctgggtggtcagaggccggggctagaggcagatggaagggaggcatttgctgacagaggacggggcacccgggctccccactgcagtcggccttgcctcctcctcctcctctacctccagtcaggctggacgggagggtagccttgtggctgagaggggtcagactaggtggcacaggggctcctggaaagacagcaggcttcctgctgggcgttcccttgttggagggaatagagtgggggtgggactctgcaggggtgtccttgtccactcgcacccctcgccgcccaccagggccatgctctgtgacttgggctgatccccaccctttctgggcctacagcaccacaggccgctgtacccccttagagctgcccctctctggcctggccggcaggcgtcttcttaactcctctgtcctctatattcagcatgttccttgtcagctgctgggccggccctgccttgcgctagcagagcctctcctggcagcttctcaggtctccctaatggagacaccaggctactaggacactggctggggccaccccctcctgcctaatgcctcaccttacagctggggaaactgaggcctggaatggcccagagtcaccaaggcaaagttggggctggtcccagcctgaggctccagctgatgccctcagctcccagagagggggtgccccatctagctgggtgcaggggtcactgcttgtcagctcagggccctgtgcccgcttgcctgttcccctacatctgtgcctgcacatccagaactgcctccttgccgctgcctccaggaagcccaccttgagccagagtcaagggctgcagcactgcccgatagaacacgcccgccctcactgctgttcttgccttacagccaccatgggaaagctgcaacctttctgttttatttaaagaaagcccaacattaaagggttttcattgcaaaaaaaaaaaaaaaaaa

SEQ ID NO: 1129 - DNA, 2190 bp, Homo sapiens
gggcaccgtaaccagcgccgcggacaccggcaccggcgccacggactccgcaggaccccgcgcccgccgccgccgctatgctggggctgctggtggcgttgctggccctggggctcgctgtctttgcgctgctggacgtctggtacctggtgcgccttccgtgcgccgtgctgcgcgcgcgcctgctgcagccgcgcgtccgtgacctgctagctgagcagcgcttcccgggccgcgtgctgccctcggacttggacctgctgttgcacatgaacaacgcgcgctacctgcgcgaggccgactttgcgcgcgtcgcgcacctgacccgctgcggggtgctcggggcgctgagggagttgcgggcgcacacggtgctggcggcctcgtgcgcgcgccaccgccgctcgctgcgcctgctggagcccttcgaggtgcgcacccgcctgctgggctgggacgaccgcgcgttctacctggaggcgcgctttgtcagcctgcgggacggtttcgtgtgcgcgctgctgcgcttccggcagcacctgctgggcacctcacccgagcgcgtcgtgcagcacctgtgccagcgcagggtggagccccctgagctgcccgctgatctgcagcactggatctcctacaacgaggccagcagccagctgctccgcatggagagtgggctcagtgatgtcaccaaggaccagtgaccgccaccttcacaccgtctgccctggccaccatcctgggcctgggggctgcccacagatgggcagtctcagccatactctgttccagctggagtagcctcctgaccagcctggcccaccctgctccacccactgggcccccccagttattgatacccctctgtgctgggctccacgctaggcagaaggaggagtggcattggcatcctgacccagctctgccctcaaggtggggatggatgggcaaaggagagtcctgcctggccctacgatgaggccactcatgtgggcctaggtaggggaggatggtgcctggagcagagggacccacaagtgcctcccgagcctagatcctggctcggaccactgcaagggccgaggcagggccagaccagagcatcctgggtacaggcctgggctctccagggcctgggcctgattcaggtgcagtgggcactcctgaagggtcagagcggcatctgccaggcagcccctctggcttccgctgaggtggttgcaggcctggggcagagcctgggtggtcagaggccggggctagaggcagatggaagggaggcatttgctgacagaggacggggcacccgggctccccactgcagtcggccttgcctcctcctcctcctctacctccagtcaggctggacgggagggtagccttgtggctgagaggggtcagactaggtggcacaggggctcctggaaagacagcaggcttcctgctgggcgttcccttgttggagggaatagagtgggggtgggactctgcaggggtgtccttgtccactcgcacccctcgccgcccaccagggccatgctctgtgacttgggctgatccccaccctttctgggcctacagcaccacaggccgctgtacccccttagagctgcccctctctggcctggccggcaggcgtcttcttaactcctctgtcctctatattcagcatgttccttgtcagctgctgggccggccctgccttgcgctagcagagcctctcctggcagcttctcaggtctccctaatggagacaccaggctactaggacactggctggggccaccccctcctgcctaatgcctcaccttacagctggggaaactgaggcctggaatggcccagagtcaccaaggcaaagttggggctggtcccagcctgaggctccagctgatgccctcagctcccagagagggggtgccccatctagctgggtgcaggggtcactgcttgtcagctcagggccctgtgcccgcttgcctgttcccctacatctgtgcctgcacatccagaactgcctccttgccgctgcctccaggaagcccaccttgagccagagtcaagggctgcagcactgcccgatagaacacgcccgccctcactgctgttcttgccttacagccaccatgggaaagctgcaacctttctgttttatttaaagaaagcccaacattaaagggttttcattgc

SEQ ID NO: 1130 - DNA, 3404 bp, Homo sapiens
ggtcaggcgcgtgaccccgcgtgaccggggtgcgcgagccgagaggccctggaagcgggactctgggaccccattgaaagaaaggcaaccagaaaaggcgaaacgacaacctcgatagtgattggagctgatggaacgagggcggagctaaagtcccagaatactggccaatcagagtttaagattatcagggagcccgggaaggggaaaggggcgaaatggttctatggtcacatgccgcggggtctggtgggaggagcggttgcccagcggcctcttggcgcttcctgtttccggttcccagagtggggcacagcgaggcgctagggggaacgctggcctctgaaactagctctgggaccggggtctgcggccggcccctagctggccccgtctcccatccccagaagggtattcactggggattctgagctttggctactccagtttcccacgacacgatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaattggatcatgctgatctataaagggggtgatgaatatgacaaccactgtggcaaggagcagcgtcgtgcagtggtgatgatctcctgcaatcgacacaccctagcggacaattttaaccctgtgtctgaggagcgtggcaaagtccaagattgtttctacctctttgagatggatagcagcctggcctgttcaccagagatctcccacctcagtgtgggttccatcttacttgtcacgtttgcatcactggttgctgtttatgttgttggggggttcctataccagcgactggtagtgggagccaaaggaatggagcagtttccccacttagccttctggcaggatcttggcaacctggtagcagatggctgtgactttgtctgccgttctaaacctcgaaatgtgcctgcagcatatcgtggtgtgggggatgaccagctgggggaggagtcagaagaaagggatgaccatttattaccaatgtagattgcactttatatgtccagcctcttcctcagtcccccaaaccaaagctacacagccagatttctcaagcagtctcaactccagtccctcatctcacccttactattgctcttgctttccagtttgcttttgatttgcatcttctcactagtaaaactgccttccctttgttccttattttctgttttttctctagagaggtacagttgtaagtcagagttaatataatagggcctgtgaaaacagaggcttttgcattgtctcttgacatcagaagttacaataggcatatgggcaaaatggtgtagcaggctcactggccgtttgttttttaaacacattttcacaagtttttgagacactggatttctttaattaaaaaaaaaatgccaagaaacattatttatacagggttgattgctttcatgttgttattctgtaccctatagtagcctccatgagaatctggtatttcttgctgcttggaactactttgcagtgattacttggttgcagtccaagtactctcgtttagtctgagcctggagatgttctagacttgcttctcccacctctgagattaggacaggaaaaatgtgaaatttcccaattacaggattatacggtaccatcacatcatttgtggaaattggggtgactgtatagctgggattgggctaaggactgtggtcttatctgtccacatacagccaaaatgcctatccagaaatccagttcgttggaaaggaaaattggtactcctgtgccacaggggttccagaaaagggaagtcactttaccttgcggtggtgggatcctgatgtctttcatccatttgtagtaaaagctggtaaagcttttcttactcctggttccctaccagtatttctaaacatgtcgcactttctccacaggcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgattttttttctttctaaacagggaaaataatgttacaaaagcatcttttttgttatttgtttgcatccctcccccacaccctggtgttttaaaatgaagaaaaaaaaccatcactttttgtacaaaaactcttaatgattaaaaaacaaacaaaacatattggccttgtcatttgtgtgaaagtgggcaaagactggaatagagtaagacaactgaaaccaattttcatccttttactgaggaaaaaaatatttaatatttttgttatataaggaatagtgcctaaggcaggtacttatactcctgacctcagccccacacactctggttttataaagctataggacagagcagagatggaactgaaaaacagggtagaaaataacataaattggaggggaacagtgggatgcagaaagaatgacaacagccacatgtgccccagtcaaatacttttagtccctgcagcagaagatgccaaccaagtctctatactggctggggatcctgccatggatgcaggagaaaaaattcaatcacaagggagtaagtgacaacaaaaagaaaaaactctgagccacagctacactgggaggggggaggaccagattttgctacttctgtcacacaagctagaaaaaccctacctctcccattgggcaggcaacctgacattccacccagttccttgccttaccatactatgtattcctcctcttggagaattaagacctgggctaaatgctccactccaggataaggctgagcagtcctagttctctagactgcctcttttataaagattggatt

SEQ ID NO: 1131 - DNA, 1079 bp, Homo sapiens
ccagagtggggcacagcgaggcgctagggggaacgctggcctctgaaactagctctgggaccggggtctgcggccggcccctagctggccccgtctcccatccccagaagggtattcactggggattctgagctttggctactccagtttcccacgacacctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaattggatcatgctgatctataaagggggtgatgaatatgacaaccactgtggcaaggagcagcgtcgtgcagtggtgatgatctcctgcaatcgacacaccctagcggacaattttaaccctgtgtctgaggagcgtggcaaagtccaagattgtttctacctctttgagatggatagcagcctggcctgttcaccagagatctcccacctcagtgtgggttccatcttacttgtcacgtttgcatcactggttgctgtttatgttgttggggggttcctataccagcgactggtagtgggagccaaaggaatggagcagtttccccacttagccttctggcaggatcttggcaacctggtagcagcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggac

SEQ ID NO: 1132 - DNA, 2872 bp, Homo sapiens
ggttcccagagtggggcacagcgaggcgctagggggaacgctggcctctgaaactagctctgggaccggggtctgcggccggcccctagctggccccgtctcccatccccagaagggtattcactggggattctgagctttggctactccagtttcccacgacacgtgagtgatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaattggatcatgctgatctataaagggggtgatgaatatgacaaccactgtggcaaggagcagcgtcgtgcagtggtgatgatctcctgcaatcgacacaccctagcggacaattttaaccctgtgtctgaggagcgtggcaaagtccaagattgtttctacctctttgagatggatagcagcctggcctgttcaccagagatctcccacctcagtgtgggttccatcttacttgtcacgtttgcatcactggttgctgtttatgttgttggggggttcctataccagcgactggtagtgggagccaaaggaatggagcagtttccccacttagccttctggcaggatcttggcaacctggtagcagatggctgtgactttgtctgccgttctaaacctcgaaatgtgcctgcagcatatcgtggtgtgggggatgaccagctgggggaggagtcagaagaaagggatgaccatttattaccaatgtagattgcactttatatgtccagcctcttcctcagtcccccaaaccaaagctacacagccagatttctcaagcagtctcaactccagtccctcatctcacccttactattgctcttgctttccagtttgcttttgatttgcatcttctcactagtaaaactgccttccctttgttccttattttctgttttttctctagagaggtacagttgtaagtcagagttaatataatagggcctgtgaaaacagaggcttttgcattgtctcttgacatcagaagttacaataggcatatgggcaaaatggtgtagcaggctcactggccgtttgttttttaaacacattttcacaagtttttgagacactggatttctttaattaaaaaaaaaatgccaagaaacattatttatacagggttgattgctttcatgttgttattctgtaccctatagtagcctccatgagaatctggtatttcttgctgcttggaactactttgcagtgattacttggttgcagtccaagtactctcgtttagtctgagcctggagatgttctagacttgcttctcccacctctgagattaggacaggaaaaatgtgaaatttcccaattacaggattatacggtaccatcacatcatttgtggaaattggggtgactgtatagctgggattgggctaaggactgtggtcttatctgtccacatacagccaaaatgcctatccagaaatccagttcgttggaaaggaaaattggtactcctgtgccacaggggttccagaaaagggaagtcactttaccttgcggtggtgggatcctgatgtctttcatccatttgtagtaaaagctggtaaagcttttcttactcctggttccctaccagtatttctaaacatgtcgcactttctccacaggcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgattttttttctttctaaacagggaaaataatgttacaaaagcatcttttttgttatttgtttgcatccctcccccacaccctggtgttttaaaatgaagaaaaaaaaccatcactttttgtacaaaaactcttaatgattaaaaaacaaacaaaacatattggccttgtcatttgtgtgaaagtgggcaaagactggaatagagtaagacaactgaaaccaattttcatccttttactgaggaaaaaaatatttaatatttttgttatataaggaatagtgcctaaggcaggtacttatactcctgacctcagccccacacactctggttttataaagctataggacagagcagagatggaactgaaaaacagggtagaaaataacataaattggaggggaacagtgggatgcagaaagaatgacaacagccacattgaatggggctggatctgtgtgtaggtggctgagctaataagtgtctggctgggcgcaggtgtggctgtccgtgtcaggttcatgcccacattctgctggccactcccatctgcttctgccttcttggctg

SEQ ID NO: 1133 - DNA, 3161 bp, Homo sapiens
ggtcaggcgcgtgaccccgcgtgaccggggtgcgcgagccgagaggccctggaagcgggactctgggaccccattgaaagaaaggcaaccagaaaaggcgaaacgacaacctcgatagtgattggagctgatggaacgagggcggagctaaagtcccagaatactggccaatcagagtttaagattatcagggagcccgggaaggggaaaggggcgaaatggttctatggtcacatgccgcggggtctggtgggaggagcggttgcccagcggcctcttggcgcttcctgtttccggttcccagagtggggcacagcgaggcgctagggggaacgctggcctctgaaactagctctgggaccggggtctgcggccggcccctagctggccccgtctcccatccccagaagggtattcactggggattctgagctttggctactccagtttcccacgacacgatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaattggatcatgctgatctataaagggggtgatgaatatgacaaccactgtggcaaggagcagcgtcgtgcagtggtgatgatctcctgcaatcgacacaccctagcggacaattttaaccctgtgtctgaggagcgtggcaaagtccaagattgtttctacctctttgagatggatagcagcctggcctgttcaccagagatctcccacctcagtgtgggttccatcttacttgtcacgtttgcatcactggttgctgtttatgttgttggggggttcctataccagcgactggtagtgggagccaaaggaatggagcagtttccccacttagccttctggcaggatcttggcaacctggtagcagatggctgtgactttgtctgccgttctaaacctcgaaatgtgcctgcagcatatcgtggtgtgggggatgaccagctgggggaggagtcagaagaaagggatgaccatttattaccaatgtagattgcactttatatgtccagcctcttcctcagtcccccaaaccaaagctacacagccagatttctcaagcagtctcaactccagtccctcatctcacccttactattgctcttgctttccagtttgcttttgatttgcatcttctcactagtaaaactgccttccctttgttccttattttctgttttttctctagagaggtacagttgtaagtcagagttaatataatagggcctgtgaaaacagaggcttttgcattgtctcttgacatcagaagttacaataggcatatgggcaaaatggtgtagcaggctcactggccgtttgttttttaaacacattttcacaagtttttgagacactggatttctttaattaaaaaaaaaatgccaagaaacattatttatacagggttgattgctttcatgttgttattctgtaccctatagtagcctccatgagaatctggtatttcttgctgcttggaactactttgcagtgattacttggttgcagtccaagtactctcgtttagtctgagcctggagatgttctagacttgcttctcccacctctgagattaggacaggaaaaatgtgaaatttcccaattacaggattatacggtaccatcacatcatttgtggaaattggggtgactgtatagctgggattgggctaaggactgtggtcttatctgtccacatacagccaaaatgcctatccagaaatccagttcgttggaaaggaaaattggtactcctgtgccacaggggttccagaaaagggaagtcactttaccttgcggtggtgggatcctgatgtctttcatccatttgtagtaaaagctggtaaagcttttcttactcctggttccctaccagtatttctaaacatgtcgcactttctccacaggcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgattttttttctttctaaacagggaaaataatgttacaaaagcatcttttttgttatttgtttgcatccctcccccacaccctggtgttttaaaatgaagaaaaaaaaccatcactttttgtacaaaaactcttaatgattaaaaaacaaacaaaacatattggccttgtcatttgtgtgaaagtgggcaaagactggaatagagtaagacaactgaaaccaattttcatccttttactgaggaaaaaaatatttaatatttttgttatataaggaatagtgcctaaggcaggtacttatactcctgacctcagccccacacactctggttttataaagctataggacagagcagagatggaactgaaaaacagggtagaaaataacataaattggaggggaacagtgggatgcagaaagaatgacaacagccacattgaatggggctggatctgtgtgtaggtggctgagctaataagtgtctggctgggcgcaggtgtggctgtccgtgtcaggttcatgcccacattctgctggccactcccatctgcttctgccttcttggctg

SEQ ID NO: 1134 - DNA, 2428 bp, Homo sapiens
cgaggcgctagggggaacgctggcctctgaaactagctctgggaccggggtctgcggccggcccctagctggccccgtctcccatccccagaagggtattcactggggattctgagctttggctactccagtttcccacgacacgatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaattggatcatgctgatctataaagggggtgatgaatatgacaaccactgtggcaaggagcagcgtcgtgcagtggtgatgatctcctgcaatcgacacaccctagcggacaattttaaccctgtgtctgaggagcgtggcaaagtccaagattgtttctacctctttgagatggatagcagcctggcctgttcaccagagatctcccacctcagtgtgggttccatcttacttgtcacgtttgcatcactggttgctgtttatgttgttggggggttcctataccagcgactggtagtgggagccaaaggaatggagcagtttccccacttagccttctggcaggatcttggcaacctggtagcagatggctgtgactttgtctgccgttctaaacctcgaaatgtgcctgcagcatatcgtggtgtgggggatgaccagctgggggaggagtcagaagaaagggatgaccatttattaccaatgtagattgcactttatatgtccagcctcttcctcagtcccccaaaccaaagctacacagccagatttctcaagcagtctcaactccagtccctcatctcacccttactattgctcttgctttccagtttgcttttgatttgcatcttctcactagtaaaactgccttccctttgttccttattttctgttttttctctagagaggtacagttgtaagtcagagttaatataatagggcctgtgaaaacagaggcttttgcattgtctcttgacatcagaagttacaataggcatatgggcaaaatggtgtagcaggctcactggccgtttgttttttaaacacattttcacaagtttttgagacactggatttctttaattaaaaaaaaaatgccaagaaacattatttatacagggttgattgctttcatgttgttattctgtaccctatagtagcctccatgagaatctggtatttcttgctgcttggaactactttgcagtgattacttggttgcagtccaagtactctcgtttagtctgagcctggagatgttctagacttgcttctcccacctctgagattaggacaggaaaaatgtgaaatttcccaattacaggattatacggtaccatcacatcatttgtggaaattggggtgactgtatagctgggattgggctaaggactgtggtcttatctgtccacatacagccaaaatgcctatccagaaatccagttcgttggaaaggaaaattggtactcctgtgccacaggggttccagaaaagggaagtcactttaccttgcggtggtgggatcctgatgtctttcatccatttgtagtaaaagctggtaaagcttttcttactcctggttccctaccagtatttctaaacatgtcgcactttctccacaggcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgatttttttctttctaaacagggaaaataatgttacaaaagcatcttttttgttatttgtttgcatccctcccccacaccctggtgttttaaaatgaagaaaaaaaaccatcaccttttgtacaaaaactcttaatgattaaaaaacaaac

SEQ ID NO: 1135 - DNA, 2727 bp, Homo sapiens
cgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcgcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccgtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccagggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagttcctcaggcgttggctggttgggggactgtggtcctggggcctggtttattgactgt

SEQ ID NO: 1136 - DNA, 3146 bp, Homo sapiens
cggcggcgaagagacgcgggttgaggaagagggacggattgcccatgcgcttgggcgcacagcggcccgcttctgtgtggtctggaggtggagctgagaggggaatcacactctataaaggttcgcataccccactggcggattcaattgcggcagtgacgtcacagaggccccgccccgcccccacaagagccccaccgacgtggggttggcggtggtggaaggactaggagttggcgcgtgcgtactggcggcctctcccgcaccgaccggcctgggccccgcccccgggcgtgaggcgcccaatgcgcgtgcgcggcggcgtcggcgccagttatttctgtcccgccccccggcctcggctctttctgcgagcgggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccagggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagttcctcaggcgttggctggttgggggactgtggtcctggggcctggtttattgactgt

SEQ ID NO: 1137 - DNA, 2989 bp, Homo sapiens
ggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccgtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccagggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagttaaaaaaaaaaaaaaaaaaaaaaaaaaaaaa

SEQ ID NO: 1138 - DNA, 3392 bp, Homo sapiens
cggcggcgaagagacgcgggttgaggaagagggacggattgcccatgcgcttgggcgcacagcggcccgcttctgtgtggtctggaggtggagctgagaggggaatcacactctataaaggttcgcataccccactggcggattcaattgcggcagtgacgtcacagaggccccgccccgcccccacaagagccccaccgacgtggggttggcggtggtggaaggactaggagttggcgcgtgcgtactggcggcctctcccgcaccgaccggcctgggccccgcccccgggcgtgaggcgcccaatgcgcgtgcgcggcggcgtcggcgccagttatttctgtcccgccccccggcctcggctctttctgcgagcgggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccgtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccagggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagttcctcaggcgttggctggttgggggactgtggtcctggggcctggtttattgactgt

SEQ ID NO: 1139 - DNA, 1585 bp, Homo sapiens
gcgagatccctactggctataaaggcagcgccccggagagctcttgcgcgtcttgttcttgcctggtgtcggtggttagtttctgcgacttgtgttgggactgctgataggaagatgtcttcaggaaatgctaaaattgggcaccctgcccccaacttcaaagccacagctgttatgccagatggtcagtttaaagatatcagcctgtctgactacaaaggaaaatatgttgtgttcttcttttaccctcttgacttcacctttgtgtgccccacggagatcattgctttcagtgatagggcagaagaatttaagaaactcaactgccaagtgattggtgcttctgtggattctcacttctgtcatctagcatgggtcaatacacctaagaaacaaggaggactgggacccatgaacattcctttggtatcagacccgaagcgcaccattgctcaggattatggggtcttaaaggctgatgaaggcatctcgttcaggggcctttttatcattgatgataagggtattcttcggcagatcactgtaaatgacctccctgttggccgctctgtggatgagactttgagactagttcaggccttccagttcactgacaaacatggggaagtgtgcccagctggctggaaacctggcagtgataccatcaagcctgatgtccaaaagagcaaagaatatttctccaagcagaagtgagcgctgggctgttttagtgccaggctgcggtgggcagccatgagaacaaaacctcttctgtattttttttttccattagtaaaacacaagacttcagattcagccgaattgtggtgtcttacaaggcaggcctttcctacagggggtggagagaccagcctttcttcctttggtaggaatggcctgagttggcgttgtgggcaggctactggtttgtatgatgtattagtagagcaacccattaatcttttgtagtttgtattaaacttgaactgagaccttgatgagtctttattttaggaagcatattattagcttttgattttaagaggaatttactccttgctttccctgttttggggaaaatgaggagagctgcctccaaatcagggaattatattgacacaggtagatatagggaatggaactgaatgaacccaaggtgttacattttgtttcactacacatgagggagaagaataagccctgctatagtgttggccagagcactgcgactgacgccacaggctgggttaccagttaaagtctcagtgtgactacttggacacctatttttgtttagacacactattcaaagggctgcatgggaaccagaagcttggcctcttctgataaatgcctggtacctgctatgtaaaagagctggaggtttctgttctttttgaactgacagaggaaagaggaagacaaggctggtggccttgggtagggctttcagtagttgcacagtactgggcaattcttagccttcccttggttctagccttgattagagatagtcttttttagtgtcattatgttgcccagagtggttctgaattccttgcctcaggtggtcctccgcctcagc

SEQ ID NO: 1140 - DNA, 1684 bp, Homo sapiens
atagaggccaggtgcggtggctcgcgcttacattcctagcactttgggaggccaaggcgggcggatcacctgaggtcaggcgttggagaccagcctagccaacatgatgaaacctcgtctctactaaaaatacaaaaaattagctgggcgtggtggtgcgtgcttgtagtcccagacactccggaggtgaggcgggagaatcgcttgagcccgggaggtggaggttgcagtaagccaacaccgtgccactgcactacagcctgggcgacaggctgataggaagatgtcttcaggaaatgctaaaattgggcaccctgcccccaacttcaaagccacagctgttatgccagatggtcagtttaaagatatcagcctgtctgactacaaaggaaaatatgttgtgttcttcttttaccctcttgacttcacctttgtgtgccccacggagatcattgctttcagtgatagggcagaagaatttaagaaactcaactgccaagtgattggtgcttctgtggattctcacttctgtcatctagcatgggtcaatacacctaagaaacaaggaggactgggacccatgaacattcctttggtatcagacccgaagcgcaccattgctcaggattatggggtcttaaaggctgatgaaggcatctcgttcaggggcctttttatcattgatgataagggtattcttcggcagatcactgtaaatgacctccctgttggccgctctgtggatgagactttgagactagttcaggccttccagttcactgacaaacatggggaagtgtgcccagctggctggaaacctggcagtgataccatcaagcctgatgtccaaaagagcaaagaatatttctccaagcagaagtgagcgctgggctgttttagtgccaggctgcggtgggcagccatgagaacaaaacctcttctgtattttttttttccattagtaaaacacaagacttcagattcagccgaattgtggtgtcttacaaggcaggcctttcctacagggggtggaatgtattagtagagcaacccattaatcttttgtagtttgtattaaacttgaactgagaccttgatgagtctttattttaggaagcatattattagcttttgattttaagaggaatttactccttgctttccctgttttggggaaaatgaggagagctgcctccaaatcagggaattatattgacacaggtagatatagggaatggaactgaatgaacccaaggtgttacattttgtttcactacacatgagggagaagaataagccctgctatagtgttggccagagcactgcgactgacgccacaggctgggttaccagttaaagtctcagtgtgactacttggacacctatttttgtttagacacactattcaaagggctgcatgggaaccagaagcttggcctcttctgataaatgcctggtacctgctatgtaaaagagctggaggtttctgttctttttgaactgacagaggaaagaggaagacaaggctggtggccttgggtagggctttcagtagttgcacagtactgggcaattcttagccttcccttggttctagccttgattagagatagtcttttttagtgtcattatgttgcccagagtggttctgaattccttgcctcaggtggtcctccgcctcagc

SEQ ID NO: 1141 - DNA, 1745 bp, Homo sapiens
gcctggtgtcggtggttagtttctgcgacttgtgttgggactggtgagtgtgggcagtgcggcccctgcggagtgaggcgcggcgcgcccttcttgcctgttgcctcttcctcctcctgtccggggcccgcccgcgctcgggtgggggtgctgtgatgcgtgaggcagccgggggaggcccggagtccgagactgcttgagcgctgcgcacacccctctcgtgggccccccacgtaggtgcgggaacctggttgaaccccaagctgataggaagatgtcttcaggaaatgctaaaattgggcaccctgcccccaacttcaaagccacagctgttatgccagatggtcagtttaaagatatcagcctgtctgactacaaaggaaaatatgttgtgttcttcttttaccctcttgacttcacctttgtgtgccccacggagatcattgctttcagtgatagggcagaagaatttaagaaactcaactgccaagtgattggtgcttctgtggattctcacttctgtcatctagcatgggtcaatacacctaagaaacaaggaggactgggacccatgaacattcctttggtatcagacccgaagcgcaccattgctcaggattatggggtcttaaaggctgatgaaggcatctcgttcaggggcctttttatcattgatgataagggtattcttcggcagatcactgtaaatgacctccctgttggccgctctgtggatgagactttgagactagttcaggccttccagttcactgacaaacatggggaagtgtgcccagctggctggaaacctggcagtgataccatcaagcctgatgtccaaaagagcaaagaatatttctccaagcagaagtgagcgctgggctgttttagtgccaggctgcggtgggcagccatgagaacaaaacctcttctgtattttttttttccattagtaaaacacaagacttcagattcagccgaattgtggtgtcttacaaggcaggcctttcctacagggggtggagagaccagcctttcttcctttggtaggaatggcctgagttggcgttgtgggcaggctactggtttgtatgatgtattagtagagcaacccattaatcttttgtagtttgtattaaacttgaactgagaccttgatgagtctttattttaggaagcatattattagcttttgattttaagaggaatttactccttgctttccctgttttggggaaaatgaggagagctgcctccaaatcagggaattatattgacacaggtagatatagggaatggaactgaatgaacccaaggtgttacattttgtttcactacacatgagggagaagaataagccctgctatagtgttggccagagcactgcgactgacgccacaggctgggttaccagttaaagtctcagtgtgactacttggacacctatttttgtttagacacactattcaaagggctgcatgggaaccagaagcttggcctcttctgataaatgcctggtacctgctatgtaaaagagctggaggtttctgttctttttgaactgacagaggaaagaggaagacaaggctggtggccttgggtagggctttcagtagttgcacagtactgggcaattcttagccttcccttggttctagccttgattagagatagtcttttttagtgtcattatgttgcccagagtggttctgaattccttgcctcaggtggtcctccgcctcagc

SEQ ID NO: 1142 - DNA, 937 bp, Homo sapiens
gttcttgcctggtgtcggtggttagtttctgcgacttgtgttgggactgctgataggaagatgtcttcaggaaatgctaaaattgggcaccctgcccccaacttcaaagccacagctgttatgccagatggtcagtttaaagatatcagcctgtctgactacaaaggaaaatatgttgtgttcttcttttaccctcttgacttcacctttgtgtgccccacggagatcattgctttcagtgatagggcagaagaatttaagaaactcaactgccaagtgattggtgcttctgtggattctcacttctgtcatctagcatgggtcaatacacctaagaaacaaggaggactgggacccatgaacattcctttggtatcagacccgaagcgcaccattgctcaggattatggggtcttaaaggctgatgaaggcatctcgttcaggggcctttttatcattgatgataagggtattcttcggcagatcactgtaaatgacctccctgttggccgctctgtggatgagactttgagactagttcaggccttccagttcactgacaaacatggggaagtgtgcccagctggctggaaacctggcagtgataccatcaagcctgatgtccaaaagagcaaagaatatttctccaagcagaagtgagcgctgggctgttttagtgccaggctgcggtgggcagccatgagaacaaaacctcttctgtattttttttttccattagtaaaacacaagacttcagattcagccgaattgtggtgtcttacaaggcaggcctttcctacagggggtggagagaccagcctttcttcctttggtaggaatggcctgagttggcgttgtgggcaggctactggtttgtatgatgtattagtagagcaacccattaatcttttgtagtttgtattaaacttgaactgag

SEQ ID NO: 1143 - DNA, 1754 bp, Homo sapiens
atagaggccaggtgcggtggctcgcgcttacattcctagcactttgggaggccaaggcgggcggatcacctgaggtcaggcgttggagaccagcctagccaacatgatgaaacctcgtctctactaaaaatacaaaaaattagctgggcgtggtggtgcgtgcttgtagtcccagacactccggaggtgaggcgggagaatcgcttgagcccgggaggtggaggttgcagtaagccaacaccgtgccactgcactacagcctgggcgacaggctgataggaagatgtcttcaggaaatgctaaaattgggcaccctgcccccaacttcaaagccacagctgttatgccagatggtcagtttaaagatatcagcctgtctgactacaaaggaaaatatgttgtgttcttcttttaccctcttgacttcacctttgtgtgccccacggagatcattgctttcagtgatagggcagaagaatttaagaaactcaactgccaagtgattggtgcttctgtggattctcacttctgtcatctagcatgggtcaatacacctaagaaacaaggaggactgggacccatgaacattcctttggtatcagacccgaagcgcaccattgctcaggattatggggtcttaaaggctgatgaaggcatctcgttcaggggcctttttatcattgatgataagggtattcttcggcagatcactgtaaatgacctccctgttggccgctctgtggatgagactttgagactagttcaggccttccagttcactgacaaacatggggaagtgtgcccagctggctggaaacctggcagtgataccatcaagcctgatgtccaaaagagcaaagaatatttctccaagcagaagtgagcgctgggctgttttagtgccaggctgcggtgggcagccatgagaacaaaacctcttctgtattttttttttccattagtaaaacacaagacttcagattcagccgaattgtggtgtcttacaaggcaggcctttcctacagggggtggagagaccagcctttcttcctttggtaggaatggcctgagttggcgttgtgggcaggctactggtttgtatgatgtattagtagagcaacccattaatcttttgtagtttgtattaaacttgaactgagaccttgatgagtctttattttaggaagcatattattagcttttgattttaagaggaatttactccttgctttccctgttttggggaaaatgaggagagctgcctccaaatcagggaattatattgacacaggtagatatagggaatggaactgaatgaacccaaggtgttacattttgtttcactacacatgagggagaagaataagccctgctatagtgttggccagagcactgcgactgacgccacaggctgggttaccagttaaagtctcagtgtgactacttggacacctatttttgtttagacacactattcaaagggctgcatgggaaccagaagcttggcctcttctgataaatgcctggtacctgctatgtaaaagagctggaggtttctgttctttttgaactgacagaggaaagaggaagacaaggctggtggccttgggtagggctttcagtagttgcacagtactgggcaattcttagccttcccttggttctagccttgattagagatagtcttttttagtgtcattatgttgcccagagtggttctgaattccttgcctcaggtggtcctccgcctcagc

SEQ ID NO: 1144 - DNA, 1960 bp, Homo sapiens
tcggtggttagtttctgcgacttgtgttgggactggtgagtgtgggcagtgcggcccctgcggagtgaggcgcggcgcgcccttcttgcctgttgcctcttcctcctcctgtccggggcccgcccgcgctcgggtgggggtgctgtgatgcgtgaggcagccgggggaggcccggagtccgagactgcttgagcgctgcgcacacccctctcgtgggccccccacgtaggtgcgggaacctggttgaaccccaaggcaagcgtggactcgagtcgagtcttcccccggcaactcgagcacgtggcgcggcgtctgggcgggctggtggtgggggtctccgagactagcctcctgccggacggggtgggttcgggaagcttctggaatggacctgtatccagactcgtggctgtagaagacagcctctatgtatttggctgttccgggtcctgagccttgactagctgcggagcttcggctgataggaagatgtcttcaggaaatgctaaaattgggcaccctgcccccaacttcaaagccacagctgttatgccagatggtcagtttaaagatatcagcctgtctgactacaaaggaaaatatgttgtgttcttcttttaccctcttgacttcacctttgtgtgccccacggagatcattgctttcagtgatagggcagaagaatttaagaaactcaactgccaagtgattggtgcttctgtggattctcacttctgtcatctagcatgggtcaatacacctaagaaacaaggaggactgggacccatgaacattcctttggtatcagacccgaagcgcaccattgctcaggattatggggtcttaaaggctgatgaaggcatctcgttcaggggcctttttatcattgatgataagggtattcttcggcagatcactgtaaatgacctccctgttggccgctctgtggatgagactttgagactagttcaggccttccagttcactgacaaacatggggaagtgtgcccagctggctggaaacctggcagtgataccatcaagcctgatgtccaaaagagcaaagaatatttctccaagcagaagtgagcgctgggctgttttagtgccaggctgcggtgggcagccatgagaacaaaacctcttctgtattttttttttccattagtaaaacacaagacttcagattcagccgaattgtggtgtcttacaaggcaggcctttcctacagggggtggagagaccagcctttcttcctttggtaggaatggcctgagttggcgttgtgggcaggctactggtttgtatgatgtattagtagagcaacccattaatcttttgtagtttgtattaaacttgaactgagaccttgatgagtctttattttaggaagcatattattagcttttgattttaagaggaatttactccttgctttccctgttttggggaaaatgaggagagctgcctccaaatcagggaattatattgacacaggtagatatagggaatggaactgaatgaacccaaggtgttacattttgtttcactacacatgagggagaagaataagccctgctatagtgttggccagagcactgcgactgacgccacaggctgggttaccagttaaagtctcagtgtgactacttggacacctatttttgtttagacacactattcaaagggctgcatgggaaccagaagcttggcctcttctgataaatgcctggtacctgctatgtaaaagagctggaggtttctgttctttttgaactgacagaggaaagaggaagacaaggctggtggccttgggtagggctttcagtagttgcacagtactgggcaattcttagccttcccttggttctagccttgattagagatagtcttttttagtgtcattatgttgcccagagtggttctgaattccttgcctcaggtggtcctccgcctcagc

SEQ ID NO: 1145 - DNA, 1890 bp, Homo sapiens
tcggtggttagtttctgcgacttgtgttgggactggtgagtgtgggcagtgcggcccctgcggagtgaggcgcggcgcgcccttcttgcctgttgcctcttcctcctcctgtccggggcccgcccgcgctcgggtgggggtgctgtgatgcgtgaggcagccgggggaggcccggagtccgagactgcttgagcgctgcgcacacccctctcgtgggccccccacgtaggtgcgggaacctggttgaaccccaaggcaagcgtggactcgagtcgagtcttcccccggcaactcgagcacgtggcgcggcgtctgggcgggctggtggtgggggtctccgagactagcctcctgccggacggggtgggttcgggaagcttctggaatggacctgtatccagactcgtggctgtagaagacagcctctatgtatttggctgttccgggtcctgagccttgactagctgcggagcttcggctgataggaagatgtcttcaggaaatgctaaaattgggcaccctgcccccaacttcaaagccacagctgttatgccagatggtcagtttaaagatatcagcctgtctgactacaaaggaaaatatgttgtgttcttcttttaccctcttgacttcacctttgtgtgccccacggagatcattgctttcagtgatagggcagaagaatttaagaaactcaactgccaagtgattggtgcttctgtggattctcacttctgtcatctagcatgggtcaatacacctaagaaacaaggaggactgggacccatgaacattcctttggtatcagacccgaagcgcaccattgctcaggattatggggtcttaaaggctgatgaaggcatctcgttcaggggcctttttatcattgatgataagggtattcttcggcagatcactgtaaatgacctccctgttggccgctctgtggatgagactttgagactagttcaggccttccagttcactgacaaacatggggaagtgtgcccagctggctggaaacctggcagtgataccatcaagcctgatgtccaaaagagcaaagaatatttctccaagcagaagtgagcgctgggctgttttagtgccaggctgcggtgggcagccatgagaacaaaacctcttctgtattttttttttccattagtaaaacacaagacttcagattcagccgaattgtggtgtcttacaaggcaggcctttcctacagggggtggaatgtattagtagagcaacccattaatcttttgtagtttgtattaaacttgaactgagaccttgatgagtctttattttaggaagcatattattagcttttgattttaagaggaatttactccttgctttccctgttttggggaaaatgaggagagctgcctccaaatcagggaattatattgacacaggtagatatagggaatggaactgaatgaacccaaggtgttacattttgtttcactacacatgagggagaagaataagccctgctatagtgttggccagagcactgcgactgacgccacaggctgggttaccagttaaagtctcagtgtgactacttggacacctatttttgtttagacacactattcaaagggctgcatgggaaccagaagcttggcctcttctgataaatgcctggtacctgctatgtaaaagagctggaggtttctgttctttttgaactgacagaggaaagaggaagacaaggctggtggccttgggtagggctttcagtagttgcacagtactgggcaattcttagccttcccttggttctagccttgattagagatagtcttttttagtgtcattatgttgcccagagtggttctgaattccttgcctcaggtggtcctccgcctcagc

SEQ ID NO: 1146 - DNA, 1183 bp, Homo sapiens
  misc_feature (1)...(1183): n = A,T,C or G
cgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacttggaaatcatgacaaagcgctccaactatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgatgatgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgngattcttctgaacacaataaactattttgatgatcttgggtgg

SEQ ID NO: 1147 - DNA, 1253 bp, Homo sapiens
cacattctcttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtggaa

SEQ ID NO: 1148 - DNA, 1200 bp, Homo sapiens
cacattctcttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggagtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtggaa

SEQ ID NO: 1149 - DNA, 1331 bp, Homo sapiens
cacattctcttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagagcaacattggtgctgttgtaaagatgtactgtagaaaagtattcttcacccagcatgacccccacagaaggtgtcagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtggaa

SEQ ID NO: 1150 - DNA, 4237 bp, Homo sapiens
cagctcggtcgcccccaccggccccatggcagcccccggcgccccagctgagtacggctacatccggaccgtcctgggccagcagatcctgggacaactggacagctccagcctggcgctgccctccgaggccaagctgaagctggcggggagcagcggccgcggcggccagacagtcaagagcctgcggatccaggagcaggtgcagcagaccctcgcccggaagggccgcagctccgtgggcaacggaaatcttcaccgaaccagcagtgttcctgagtatgtctacaacctacacttggttgaaaatgattttgttggaggccgttcccctgttcctaaaacctatgacatgctaaaggctggcacaactgccacttatgaaggtcgctggggaagaggaacagcacagtacagctcccagaagtccgtggaagaaaggtccttgaggcatcctctgaggagactggagatttctcctgacagcagcccggagagggctcactacacgcacagcgattaccagtacagccagagaagccaggctgggcacaccctgcaccaccaagaaagcaggcgggccgccctcctagtgccaccgagatatgctcgttccgagatcgtgggggtcagccgtgctggcaccacaagcaggcagcgccactttgacacataccacagacagtaccagcatggctctgttagcgacaccgtttttgacagcatccctgccaacccggccctgctcacgtaccccaggccagggaccagccgcagcatgggcaacctcttggagaaggagaactacctgacggcagggctcactgtcgggcaggtcaggccgctggtgcccctgcagcccgtcactcagaacagggcttccaggtcctcctggcatcagagctccttccacagcacccgcacgctgagggaagctgggcccagtgtcgccgtggattccagcgggaggagagcgcacttgactgtcggccaggcggccgcagggggaagtgggaatctgctcactgagagaagcactttcactgactcccagctggggaatgcagacatggagatgactctggagcgagcagtgagtatgctcgaggcagaccacatgccgccatccaggatttctgctgcagctactttcatacagcacgagtgcttccagaaatctgaagctcggaagagggttaaccagcttcgtggcatcctcaagcttctgcagctcctaaaagttcagaatgaagacgttcagcgagctgtgtgtggggccttgagaaacttagtatttgaagacaatgacaacaaattggaggtggctgaactaaatggggtacctcggctgctccaggtgctgaagcaaaccagagacttggagactaaaaaacaaataacagaccatacagtcaatttaagaagtaggaatggctggccgggcgcggtggctcacgcctgtaatcccagcactttgggaggccaaggcgggcggatcacgaggtcaggagttcgagaccagcctgaccaacatggtttgctgtggaatttgtcatctaatgacaaactcaagaatctcatgataacagaagcattgcttacgctgacggagaatatcatcatccccttttctgggtggcctgaaggagactacccaaaagcaaatggtttgctcgattttgacatattctacaacgtcactggatgcctaagaaacatgagttctgctggcgctgatgggagaaaagcgatgagaagatgtgacggactcattgactcactggtccattatgtcagaggaaccattgcagattaccagccagatgacaaggccacggagaattgtgtgtgcattcttcataacctctcctaccagctggaggcagagctcccagagaaatattcccagaatatctatattcaaaaccggaatatccagactgacaacaacaaaagtattggatgttttggcagtcgaagcaggaaagtaaaagagcaataccaggacgtgccgatgccggaggaaaagagcaaccccaagggcgtggagtggctgtggcattccattgttataaggatgtatctgtccttgatcgccaaaagtgtccgcaactacacacaagaagcatccttaggagctctgcagaacctcacggccggaagtggaccaatgccgacatcagtggctcagacagttgtccagaaggaaagtggcctgcagcacacccgaaagatgctgcatgttggtgacccaagtgtgaaaaagacagccatctcgctgctgaggaatctgtcccggaatctttctctgcagaatgaaattgccaaagaaactctccctgatttggtttccatcattcctgacacagtcccgagtactgaccttctcattgaaactacagcctctgcctgttacacattgaacaacataatccaaaacagttaccagaatgcacgcgaccttctaaacaccgggggcatccagaaaattatggccattagtgcaggcgatgcctatgcctccaacaaagcaagtaaagctgcttccgtccttctgtattctctgtgggcacacacggaactgcatcatgcctacaagaaggctcagtttaagaagacagattttgtcaacagccggactgccaaagcctaccactcccttaaagactgaggaaaatgacaaagtattctcggctgcaaaaatccccaaaggaaaacacctatttttctactacccagcccaagaaacctcaaaagcatgccttgtttctatctttctctatttccgtggtcccctgaatccagaaaacaaatagaacataattttatgagtcttccagaagacctttgcaagtttgccaccagtagataccggccacaggctcgacaaatagtggtctttgttattagggcttatggtagatggcttcctggaatcaaaatgtgaattcatgtggaagggacattaatccaataaataaggaaagaagctgttgcattactgggattttaaaagtttgatttacatttatattccttttctggttcccatgttttgtcactcatgtgcacattgcttcgccattgggcctccagtgtattgttctgcagtgttgaaacagaatggaaatgacaagaaatatctgcagttatccaggagaaagtataatggcaaaattattggtttctttctttactttgtgcttgtttttatccccttggttgtttttctctgatttttaaataaacttaagaaatttagattacagagtatgcatgactgtaagaaaaagaaattgagaggaagtgatcatagcaaattaaagaagtcttttcctcccagaacttaaagtaaaataaaaaataaataaataaataaaatcttttccacagagaaaggcaactgtgatgataaaatttaagctcccccaacactgagtcaatgagatttttctcaggagatactttacctataacaacgccgttaaatccaaatctcttctaaacgatggcattctatgtaatgcctttcctggacttttttggccactgcctggactagtgaaagaatggactctatctttatctgcaagaggaactaaggccttctatcagactgcctggccagcctggggcactgaaaatacggctcatgttaatgagttacattatcagccagcccagccttgcccaccatttaagaaatatcacagagccactagatctcatatgatcttcttcaagccattattttaactcaagaaaactctagagaagaaaagtgaagaagtcatgttgaagaagatgtaagaatgtgtcaagaccatccagaaatgatatgagaaatactgatattttaaatggttgacatcatccagcgaaatgaatctacattaaatgttgttttaactgcgctatgattaaaaccattcatatagagttagtctttacaactactattctgttatttttttttttaatctgacaacatttgtcctaagtaagataagcaaaaaaattcttcaactccttttggcaagaaaactgtaacagaaaataaattttgaatgtgtacttaagtctttattatatttgaagcaattttttttcaattttaaaagctgaatgaagacaacttaggttgctaacctagttcaaaatgaaattatttagataccaatttttaaaatactggagagaatttatatgtctttttccagagttctgatgataagca

SEQ ID NO: 1151 - DNA, 4177 bp, Homo sapiens
aggggcggggccggactcgagcggggcggggctcgcgccagcgcccccagctccgtggcggcttcgcccgcgagtccagaggcaggcgagcagctcggtcgcccccaccggccccatggcagcccccggcgccccagctgagtacggctacatccggaccgtcctgggccagcagatcctgggacaactggacagctccagcctggcgctgccctccgaggccaagctgaagctggcggggagcagcggccgcggcggccagacagtcaagagcctgcggatccaggagcaggtgcagcagaccctcgcccggaagggccgcagctccgtgggcaacggaaatcttcaccgaaccagcagtgttcctgagtatgtctacaacctacacttggttgaaaatgattttgttggaggccgttcccctgttcctaaaacctatgacatgctaaaggctggcacaactgccacttatgaaggtcgctggggaagaggaacagcacagtacagctcccagaagtccgtggaagaaaggtccttgaggcatcctctgaggagactggagatttctcctgacagcagcccggagagggctcactacacgcacagcgattaccagtacagccagagaagccaggctgggcacaccctgcaccaccaagaaagcaggcgggccgccctcctagtgccaccgagatatgctcgttccgagatcgtgggggtcagccgtgctggcaccacaagcaggcagcgccactttgacacataccacagacagtaccagcatggctctgttagcgacaccgtttttgacagcatccctgccaacccggccctgctcacgtaccccaggccagggaccagccgcagcatgggcaacctcttggagaaggagaactacctgacggcagggctcactgtcgggcaggtcaggccgctggtgcccctgcagcccgtcactcagaacagggcttccaggtcctcctggcatcagagctccttccacagcacccgcacgctgagggaagctgggcccagtgtcgccgtggattccagcgggaggagagcgcacttgactgtcggccaggcggccgcagggggaagtgggaatctgctcactgagagaagcactttcactgactcccagctggggaatgcagacatggagatgactctggagcgagcagtgagtatgctcgaggcagaccacatgctgccatccaggatttctgctgcagctactttcatacagcacgagtgcttccagaaatctgaagctcggaagagggttaaccagcttcgtggcatcctcaagcttctgcagctcctaaaagttcagaatgaagacgttcagcgagctgtgtgtggggccttgagaaacttagtatttgaagacaatgacaacaaattggaggtggctgaactaaatggggtacctcggctgctccaggtgctgaagcaaaccagagacttggagactaaaaaacaaataacaggtttgctgtggaatttgtcatctaatgacaaactcaagaatctcatgataacagaagcattgcttacgctgacggagaatatcatcatccccttttctgggtggcctgaaggagactacccaaaagcaaatggtttgctcgattttgacatattctacaacgtcactggatgcctaagaaacatgagttctgctggcgctgatgggagaaaagcgatgagaagatgtgacggactcattgactcactggtccattatgtcagaggaaccattgcagattaccagccagatgacaaggccacggagaattgtgtgtgcattcttcataacctcaataccaggacgtgccgatgccggaggaaaagagcaaccccaagggcgtggagtggctgtggcattccattgttataaggatgtatctgtccttgatcgccaaaagtgtccgcaactacacacaagaagcatccttaggagctctgcagaacctcacggccggaagtggaccaatgccgacatcagtggctcagacagttgtccagaaggaaagtggcctgcagcacacccgaaagatgctgcatgttggtgacccaagtgtgaaaaagacagccatctcgctgctgaggaatctgtcccggaatctttctctgcagaatgaaattgccaaagaaactctccctgatttggtttccatcattcctgacacagtcccgagtactgaccttctcattgaaactacagcctctgcctgttacacattgaacaacataatccaaaacagttaccagaatgcacgcgaccttctaaacaccgggggcatccagaaaattatggccattagtgcaggcgatgcctatgcctccaacaaagcaagtaaagctgcttccgtccttctgtattctctgtgggcacacacggaactgcatcatgcctacaagaaggctcagtttaagaagacagattttgtcaacagccggactgccaaagcctaccactcccttaaagactgaggaaaatgacaaagtattctcggctgcaaaaatccccaaaggaaaacacctatttttctactacccagcccaagaaacctcaaaagcatgccttgtttctatccttctctatttccgtggtcccctgaatccagaaaacaaatagaacataattttatgagtcttccagaagacctttgcaagtttgccaccagtagataccggccacaggctcgacaaatagtggtctttgttattagggcttatggtacatggcttcctggaatcaaaatgtgaattcatgtggaagggacattaatccaataaataaggaaagaagctgttgcattactgggattttaaaagtttgatttacatttatattccttttctggttcccatgttttgtcactcatgtgcacattgcttcgccattgggcctccagtgtattgttctgcagtgttgaaacagaatggaaatgacaagaaatatctgcagttatccaggagaaagtataatggcaaaattattggtttctttctttactttgtgcttgtttttatccccttgggttgtttttctctgatttttaaataaacttaagaaatttagattacagagtatgcatgactgtaagaaaaagaaattgagaggaagtgatcatagcaaattaaagaagtcttttcctcccagaacttaaagtaaaataaaaaataaataaataaataaaatcttttccacagagaaaggcaactgtgatgataaaatttaacgttcccccaaacactgagtcaatgagatttttctcaggagatactttacctataacaacgccgttaaatccaaatctcttctaaacgatggcattctatgtaatgcctttcctggacttttttggccactgccctggactagtgaaagaatggactctatctttatctgcaagaggaactaaggccttctctcagactgcctggccagcctggggcactgaaaatacggctcatgttaatgagttacattatcagccagcccagccttgcccaccatttaagaaatatcacagagccactagatctcatatgatcttcttcaagccattattttaactcaagaaaactctagagaagaaaagtgaagaagtcatgttgaagaagatgtaagaatgtgtcaagaccatccagaaatgatatgagaaatactgatattttaaatggttgacatcatccagcgaaatgaatctacattaaatgttgttttaactgcgctatgattaaaaccattcatatagagttagtctttacaactactattctgttatttttttttttaatctgacaacatttgtcctaagtaagataagcaaaaaaattcttcaactccttttggcaagaaaactgtaacagaaaataaattttgaatgtgtacttaagtctttattatatttgaagcaattttttttcaattttaaaagctgaatgaagacaacttaggttgctaacctagttcaaaatgaaattatttagataccaatttttaaaatactggagagaatttatatgtctttttccagagttctgatgataagcatttggagtgcatttattcctccagataataaatgtgtgttcagaactttttgtgttttttaaggcattaataaagccttcgataatattaaatacaaaatgagaccaa

SEQ ID NO: 1152 - DNA, 3418 bp, Homo sapiens
aggggcggggccggactcgagcggggcggggctcgcgccagcgcccccagctccgtggcggcttcgcccgcgagtccagaggcaggcgagcagctcggtcgcccccaccggccccatggcagcccccggcgccccagctgagtacggctacatccggaccgtcctgggccagcagatcctgggacaactggacagctccagcctggcgctgccctccgaggccaagctgaagctggcggggagcagcggccgcggcggccagacagtcaagagcctgcggatccaggagcaggtgcagcagaccctcgcccggaagggccgcagctccgtgggcaacggaaatcttcaccgaaccagcagtgttcctgagtatgtctacaacctacacttggttgaaaatgattttgttggaggccgttcccctgttcctaaaacctatgacatgctaaaggctggcacaactgccacttatgaaggtcgctggggaagaggaacagcacagtacagctcccagaagtccgtggaagaaaggtccttgaggcatcctctgaggagactggagatttctcctgacagcagcccggagagggctcactacacgcacagcgattaccagtacagccagagaagccaggctgggcacaccctgcaccaccaagaaagcaggcgggccgccctcctagtgccaccgagatatgctcgttccgagatcgtgggggtcagccgtgctggcaccacaagcaggcagcgccactttgacacataccacagacagtaccagcatggctctgttagcgacaccgtttttgacagcatccctgccaacccggccctgctcacgtaccccaggccagggaccagccgcagcatgggcaacctcttggagaaggagaactacctgacggcagggctcactgtcgggcaggtcaggccgctggtgcccctgcagcccgtcactcagaacagggcttccaggtcctcctggcatcagagctccttccacagcacccgcacgctgagggaagctgggcccagtgtcgccgtggattccagcgggaggagagcgcacttgactgtcggccaggcggccgcagggggaagtgggaatctgctcactgagagaagcactttcactgactcccagctggggaatgcagacatggagatgactctggagcgagcagtgagtatgctcgaggcagaccacatgctgccatccaggatttctgctgcagctactttcatacagcacgagtgcttccagaaatctgaagctcggaagagggttaaccagcttcgtggcatcctcaagcttctgcagctcctaaaagttcagaatgaagacgttcagcgagctgtgtgtggggccttgagaaacttagtatttgaagacaatgacaacaaattggaggtggctgaactaaatggggtacctcggctgctccaggtgctgaagcaaaccagagacttggagactaaaaaacaaataacagaccatacagtcaatttaagaagtaggaatggctggccgggcgcggtggctcacgcctgtaatcccagcactttgggaggccaaggcgggcggatcacgaggtcaggagttcgagaccagcctgaccaacatggtttgctgtggaatttgtcatctaatgacaaactcaagaatctcatgataacagaagcattgcttacgctgacggagaatatcatcatccccttttctgggtggcctgaaggagactacccaaaagcaaatggtttgctcgattttgacatattctacaacgtcactggatgcctaagaaacatgagttctgctggcgctgatgggagaaaagcgatgagaagatgtgacggactcattgactcactggtccattatgtcagaggaaccattgcagattaccagccagatgacaaggccacggagaattgtgtgtgcattcttcataacctctcctaccagctggaggcagagctcccagagaaatattcccagaatatctatattcaaaaccggaatatccagactgacaacaacaaaagtattggatgttttggcagtcgaagcaggaaagtaaaagagcaataccaggacgtgccgatgccggaggaaaagagcaaccccaagggcgtggagtggctgtggcattccattgttataaggatgtatctgtccttgatcgccaaaagtgtccgcaactacacacaagaagcatccttaggagctctgcagaacctcacggccggaagtggaccaatgccgacatcagtggctcagacagttgtccagaaggaaagtggcctgcagcacacccgaaagatgctgcatgttggtgacccaagtgtgaaaaagacagccatctcgctgctgaggaatctgtcccggaatctttctctgcagaatgaaattgccaaagaaactctccctgatttggtttccatcattcctgacacagtcccgagtactgaccttctcattgaaactacagcctctgcctgttacacattgaacaacataatccaaaacagttaccagaatgcacgcgaccttctaaacaccgggggcatccagaaaattatggccattagtgcaggcgatgcctatgcctccaacaaagcaagtaaagctgcttccgtccttctgtattctctgtgggcacacacggaactgcatcatgcctacaagaaggctcagtttaagaagacagattttgtcaacagccggactgccaaagcctaccactcccttaaagactgaggaaaatgacaaagtattctcggctgcaaaaatccccaaaggaaaacacctatttttctactacccagcccaagaaacctcaaaagcatgccttgtttctatccttctctatttccgtggtcccctgaatccagaaaacaaatagaacataattttatgagtcttccagaagacctttgcaagtttgccattcctggaatcaaaatgtgaattcatgtggaagggacattaatccaataaataaggaaagaagctgttgcattactgggattttaaaagtttgatttacatttatattccttttctggttcccatgttttgtcactcatgtgcacattgcttcgccattgggcctccagtgtattgttctgcagtgttgaaacagaatggaaatgacaagaaatatctgcagttatccaggagaaagtataatggcaaaattattggtttctttctttactttgtgcttgtttttatccccttgggttgtttttctctgatttttaaataaacttaagaaatttagattacagagtatgcatgactgtaagaaaaagaaattgagaggaagtgatcatagcaaattaaagaagtcttttcctcccagaacttaaagtaaaataaaaaataaataaataaataaaatcttttccacag

SEQ ID NO: 1153 - DNA, 3286 bp, Homo sapiens
aggggcggggccggactcgagcggggcggggctcgcgccagcgcccccagctccgtggcggcttcgcccgcgagtccagaggcaggcgagcagctcggtcgcccccaccggccccatggcagcccccggcgccccagctgagtacggctacatccggaccgtcctgggccagcagatcctgggacaactggacagctccagcctggcgctgccctccgaggccaagctgaagctggcggggagcagcggccgcggcggccagacagtcaagagcctgcggatccaggagcaggtgcagcagaccctcgcccggaagggccgcagctccgtgggcaacggaaatcttcaccgaaccagcagtgttcctgagtatgtctacaacctacacttggttgaaaatgattttgttggaggccgttcccctgttcctaaaacctatgacatgctaaaggctggcacaactgccacttatgaaggtcgctggggaagaggaacagcacagtacagctcccagaagtccgtggaagaaaggtccttgaggcatcctctgaggagactggagatttctcctgacagcagcccggagagggctcactacacgcacagcgattaccagtacagccagagaagccaggctgggcacaccctgcaccaccaagaaagcaggcgggccgccctcctagtgccaccgagatatgctcgttccgagatcgtgggggtcagccgtgctggcaccacaagcaggcagcgccactttgacacataccacagacagtaccagcatggctctgttagcgacaccgtttttgacagcatccctgccaacccggccctgctcacgtaccccaggccagggaccagccgcagcatgggcaacctcttggagaaggagaactacctgacggcagggctcactgtcgggcaggtcaggccgctggtgcccctgcagcccgtcactcagaacagggcttccaggtcctcctggcatcagagctccttccacagcacccgcacgctgagggaagctgggcccagtgtcgccgtggattccagcgggaggagagcgcacttgactgtcggccaggcggccgcagggggaagtgggaatctgctcactgagagaagcactttcactgactcccagctggggaatgcagacatggagatgactctggagcgagcagtgagtatgctcgaggcagaccacatgctgccatccaggatttctgctgcagctactttcatacagcacgagtgcttccagaaatctgaagctcggaagagggttaaccagcttcgtggcatcctcaagcttctgcagctcctaaaagttcagaatgaagacgttcagcgagctgtgtgtggggccttgagaaacttagtatttgaagacaatgacaacaaattggaggtggctgaactaaatggggtacctcggctgctccaggtgctgaagcaaaccagagacttggagactaaaaaacaaataacaggtttgctgtggaatttgtcatctaatgacaaactcaagaatctcatgataacagaagcattgcttacgctgacggagaatatcatcatccccttttctgggtggcctgaaggagactacccaaaagcaaatggtttgctcgattttgacatattctacaacgtcactggatgcctaagaaacatgagttctgctggcgctgatgggagaaaagcgatgagaagatgtgacggactcattgactcactggtccattatgtcagaggaaccattgcagattaccagccagatgacaaggccacggagaattgtgtgtgcattcttcataacctctcctaccagctggaggcagagctcccagagaaatattcccagaatatctatattcaaaaccggaatatccagactgacaacaacaaaagtattggatgttttggcagtcgaagcaggaaagtaaaagagcaataccaggacgtgccgatgccggaggaaaagagcaaccccaagggcgtggagtggctgtggcattccattgttataaggatgtatctgtccttgatcgccaaaagtgtccgcaactacacacaagaagcatccttaggagctctgcagaacctcacggccggaagtggaccaatgccgacatcagtggctcagacagttgtccagaaggaaagtggcctgcagcacacccgaaagatgctgcatgttggtgacccaagtgtgaaaaagacagccatctcgctgctgaggaatctgtcccggaatctttctctgcagaatgaaattgccaaagaaactctccctgatttggtttccatcattcctgacacagtcccgagtactgaccttctcattgaaactacagcctctgcctgttacacattgaacaacataatccaaaacagttaccagaatgcacgcgaccttctaaacaccgggggcatccagaaaattatggccattagtgcaggcgatgcctatgcctccaacaaagcaagtaaagctgcttccgtccttctgtattctctgtgggcacacacggaactgcatcatgcctacaagaaggctcagtttaagaagacagattttgtcaacagccggactgccaaagcctaccactcccttaaagactgaggaaaatgacaaagtattctcggctgcaaaaatccccaaaggaaaacacctatttttctactacccagcccaagaaacctcaaaagcatgccttgtttctatccttctctatttccgtggtcccctgaatccagaaaacaaatagaacataattttatgagtcttccagaagacctttgcaagtttgccattcctggaatcaaaatgtgaattcatgtggaagggacattaatccaataaataaggaaagaagctgttgcattactgggattttaaaagtttgatttacatttatattccttttctggttcccatgttttgtcactcatgtgcacattgcttcgccattgggcctccagtgtattgttctgcagtgttgaaacagaatggaaatgacaagaaatatctgcagttatccaggagaaagtataatggcaaaattattggtttctttctttactttgtgcttgtttttatccccttgggttgtttttctctgatttttaaataaacttaagaaatttagattacagagtatgcatgactgtaagaaaaagaaattgagaggaagtgatcatagcaaattaaagaagtcttttcctcccagaacttaaagtaaaataaaaaataaataaataaataaaatcttttccacag

SEQ ID NO: 1154 - DNA, 4439 bp, Homo sapiens
aggggcggggccggactcgagcggggcggggctcgcgccagcgcccccagctccgtggcggcttcgcccgcgagtccagaggcaggcgagcagctcggtcgcccccaccggccccatggcagcccccggcgccccagctgagtacggctacatccggaccgtcctgggccagcagatcctgggacaactggacagctccagcctggcgctgccctccgaggccaagctgaagctggcggggagcagcggccgcggcggccagacagtcaagagcctgcggatccaggagcaggtgcagcagaccctcgcccggaagggccgcagctccgtgggcaacggaaatcttcaccgaaccagcagtgttcctgagtatgtctacaacctacacttggttgaaaatgattttgttggaggccgttcccctgttcctaaaacctatgacatgctaaaggctggcacaactgccacttatgaaggtcgctggggaagaggaacagcacagtacagctcccagaagtccgtggaagaaaggtccttgaggcatcctctgaggagactggagatttctcctgacagcagcccggagagggctcactacacgcacagcgattaccagtacagccagagaagccaggctgggcacaccctgcaccaccaagaaagcaggcgggccgccctcctagtgccaccgagatatgctcgttccgagatcgtgggggtcagccgtgctggcaccacaagcaggcagcgccactttgacacataccacagacagtaccagcatggctctgttagcgacaccgtttttgacagcatccctgccaacccggccctgctcacgtaccccaggccagggaccagccgcagcatgggcaacctcttggagaaggagaactacctgacggcagggctcactgtcgggcaggtcaggccgctggtgcccctgcagcccgtcactcagaacagggcttccaggtcctcctggcatcagagctccttccacagcacccgcacgctgagggaagctgggcccagtgtcgccgtggattccagcgggaggagagcgcacttgactgtcggccaggcggccgcagggggaagtgggaatctgctcactgagagaagcactttcactgactcccagctggggaatgcagacatggagatgactctggagcgagcagtgagtatgctcgaggcagaccacatgctgccatccaggatttctgctgcagctactttcatacagcacgagtgcttccagaaatctgaagctcggaagagggttaaccagcttcgtggcatcctcaagcttctgcagctcctaaaagttcagaatgaagacgttcagcgagctgtgtgtggggccttgagaaacttagtatttgaagacaatgacaacaaattggaggtggctgaactaaatggggtacctcggctgctccaggtgctgaagcaaaccagagacttggagactaaaaaacaaataacagaccatacagtcaatttaagaagtaggaatggctggccgggcgcggtggctcacgcctgtaatcccagcactttgggaggccaaggcgggcggatcacgaggtcaggagttcgagaccagcctgaccaacatggtttgctgtggaatttgtcatctaatgacaaactcaagaatctcatgataacagaagcattgcttacgctgacggagaatatcatcatccccttttctgggtggcctgaaggagactacccaaaagcaaatggtttgctcgattttgacatattctacaacgtcactggatgcctaagaaacatgagttctgctggcgctgatgggagaaaagcgatgagaagatgtgacggactcattgactcactggtccattatgtcagaggaaccattgcagattaccagccagatgacaaggccacggagaattgtgtgtgcattcttcataacctctcctaccagctggaggcagagctcccagagaaatattcccagaatatctatattcaaaaccggaatatccagactgacaacaacaaaagtattggatgttttggcagtcgaagcaggaaagtaaaagagcaataccaggacgtgccgatgccggaggaaaagagcaaccccaagggcgtggagtggctgtggcattccattgttataaggatgtatctgtccttgatcgccaaaagtgtccgcaactacacacaagaagcatccttaggagctctgcagaacctcacggccggaagtggaccaatgccgacatcagtggctcagacagttgtccagaaggaaagtggcctgcagcacacccgaaagatgctgcatgttggtgacccaagtgtgaaaaagacagccatctcgctgctgaggaatctgtcccggaatctttctctgcagaatgaaattgccaaagaaactctccctgatttggtttccatcattcctgacacagtcccgagtactgaccttctcattgaaactacagcctctgcctgttacacattgaacaacataatccaaaacagttaccagaatgcacgcgaccttctaaacaccgggggcatccagaaaattatggccattagtgcaggcgatgcctatgcctccaacaaagcaagtaaagctgcttccgtccttctgtattctctgtgggcacacacggaactgcatcatgcctacaagaaggctcagtttaagaagacagattttgtcaacagccggactgccaaagcctaccactcccttaaagactgaggaaaatgacaaagtattctcggctgcaaaaatccccaaaggaaaacacctatttttctactacccagcccaagaaacctcaaaagcatgccttgtttctatccttctctatttccgtggtcccctgaatccagaaaacaaatagaacataattttatgagtcttccagaagacctttgcaagtttgccaccagtagataccggccacaggctcgacaaatagtggtctttgttattagggcttatggtacatggcttcctggaatcaaaatgtgaattcatgtggaagggacattaatccaataaataaggaaagaagctgttgcattactgggattttaaaagtttgatttacatttatattccttttctggttcccatgttttgtcactcatgtgcacattgcttcgccattgggcctccagtgtattgttctgcagtgttgaaacagaatggaaatgacaagaaatatctgcagttatccaggagaaagtataatggcaaaattattggtttctttctttactttgtgcttgtttttatccccttgggttgtttttctctgatttttaaataaacttaagaaatttagattacagagtatgcatgactgtaagaaaaagaaattgagaggaagtgatcatagcaaattaaagaagtcttttcctcccagaacttaaagtaaaataaaaaataaataaataaataaaatcttttccacagagaaaggcaactgtgatgataaaatttaacgttcccccaaacactgagtcaatgagatttttctcaggagatactttacctataacaacgccgttaaatccaaatctcttctaaacgatggcattctatgtaatgcctttcctggacttttttggccactgccctggactagtgaaagaatggactctatctttatctgcaagaggaactaaggccttctctcagactgcctggccagcctggggcactgaaaatacggctcatgttaatgagttacattatcagccagcccagccttgcccaccatttaagaaatatcacagagccactagatctcatatgatcttcttcaagccattattttaactcaagaaaactctagagaagaaaagtgaagaagtcatgttgaagaagatgtaagaatgtgtcaagaccatccagaaatgatatgagaaatactgatattttaaatggttgacatcatccagcgaaatgaatctacattaaatgttgttttaactgcgctatgattaaaaccattcatatagagttagtctttacaactactattctgttatttttttttttaatctgacaacatttgtcctaagtaagataagcaaaaaaattcttcaactccttttggcaagaaaactgtaacagaaaataaattttgaatgtgtacttaagtctttattatatttgaagcaattttttttcaattttaaaagctgaatgaagacaacttaggttgctaacctagttcaaaatgaaattatttagataccaatttttaaaatactggagagaatttatatgtctttttccagagttctgatgataagcatttggagtgcatttattcctccagataataaatgtgtgttcagaactttttgtgttttttaaggcattaataaagccttcgataatattaaatacaaaatgagaccaa

SEQ ID NO: 1155 - DNA, 4242 bp, Homo sapiens
gcggccgctgctgaggcggagactccccgccgccgcttcctccacccccagtccgccggcctcgcggcgctgagggcgggagcgcgcagagctcttccctcctcctttttcttcctcctcctcctcctcctccgggtccccgcccagcacccctcgcaccaggcggcggcggcggaggaggagagctagacccgccgccggggcacaacatggcggagccctcggccccggagagcaagcacaagtcgtccctcaactcgtccccgtggagtggcctcatggccctgggaaacagccggcacggccaccacgggcccggggcccagtgcgcgcacaaggcggcgggcggcgcggcgccgccgaagccggccccggcggggctgtccggggggctgtcgcagccggctgggtggcagtcgcttctctccttcaccatcctcttcctggcctggcttgccggcttcagctcgcgcctcttcgccgtcatccgcttcgaaagcatcatccacgagttcgacccgtggtttaactatagatcaacacatcatcttgcatctcatgggttctatgaatttttaaattggtttgatgaaagagcatggtatccactaggaagaatagtaggtggtactgtttacccagggttgatgataaccgctggccttattcattggattttaaatacattgaacataactgttcacataagagacgtatgtgtgttccttgcaccaacttttagcggccttacatctatatctactttcctgcttacaagagaactttggaaccaaggagcaggacttttagctgcttgttttattgctattgtaccaggctacatatctcggtcagtagctggatcctttgataatgaaggcattgctatttttgcacttcagttcacatactatttatgggtaaaatctgtaaaaactgggtcagttttttggacaatgtgctgctgcttatcctatttctatatggtctctgcttggggtggttatgtatttatcatcaatcttattccactgcatgtatttgtgttgttactgatgcagagatacagcaaaagagtctacatagcatatagcactttctacattgtgggtttaatattatcaatgcagataccttttgtgggattccagccaatcagaacaagtgaacacatggcagctgcaggtgtctttgcattgctgcaagcttatgctttcttgcagtatctgagagaccgattaacaaaacaagagttccagacccttttctttttgggtgtatcactagctgcaggtgctgtgttccttagtgtcatctatttgacttatacaggttacattgcaccatggagtggcaggttttattcattgtgggatactgggtatgcaaaaatacacattccaattattgcatcagtgtctgagcatcaacctacgacttgggtgtctttcttctttgatctacatattcttgtatgtaccttcccagcaggcctttggttctgcatcaaaaatatcaacgatgaaagagtatttgttgctctatatgcaatcagtgctgtctactttgctggagtgatggtgcgactgatgttgactttgactccagtcgtgtgtatgctgtctgcaattgccttttcaaatgtttttgagcactatttgggggatgacatgaaaagggaaaatccacctgtggaggacagcagtgatgaggatgacaaaagaaaccaaggaaatttgtatgataaggcaggtaaagtgaggaaacatgcaactgaacaggaaaaaactgaagagggattaggccctaatataaaaagcattgtcaccatgttgatgctgatgctattgatgatgtttgctgtccactgtacctgggtcacaagcaatgcctactctagtccaagtgtagtcctggcctcatacaatcatgatggcaccaggaatatcttagatgattttagagaagcttacttttggctaaggcaaaatacagatgaacatgcacgagtaatgtcttggtgggattatggctatcagatagctggaatggctaatagaactacgttggtggataataacacctggaataacagccacatagcactggtgggaaaagctatgtcttctaatgaaacagcagcctataaaatcatgaggactctagatgtagattatgttttggttatttttggaggggttattggctattctggtgatgatatcaacaaatttctctggatggttaggatagctgaaggagaacatcccaaagacattcgggaaagtgactattttaccccacagggagaattccgtgtagacaaagcaggatcccctactttgttgaattgccttatgtataaaatgtcatactacagatttggagaaatgcagctggattttcgtacacccccaggttttgaccgaacacgtaatgctgagattggaaataaggacattaaattcaaacatttggaagaagcctttacatcagaacactggcttgttaggatatataaagtaaaagcacctgataacagggagacattagatcacaaacctcgagtcaccaacattttcccaaaacagaagtatttgtcaaagaagactaccaaaaggaagcgtggctacattaaaaataagctggtttttaagaaaggcaagaaaatatctaagaagactgtttaaatgcactgttctggttcctaacttgaagcagttgtccttgtgagaaccggtctttgcctttagctcatgtcgtgtttcacagcaaagagggtacagaaccatcactggtccaggttaatgtacaaaattttctggcaatgcctgattaaaaaaataaaattggcttgttgagaacagctgttttcgatttctaatgtgaagcaagacagagcactgctgtaaatgtctagcagcagattttttttttattggtacatattatccttcaaatctgagaatttggactaactgcaccaaagaaccctctaatttggtccctggcacatgcatacttgtcaatgtttttattcttttacaagacctgcattttatttgaattacccgaatagcaatatgtaaaatacaagtgacaaaatgtgatgagagcttcttgaaccggtaaactagtacaggtctgagaaagacatattagaagaatcattatacttccttgaattatatttattttcatgtttctctaatgcaaagaatgtttcatcaaatgtatattttctgttgcttactgtttgctctgagaagaagctgctgtttcaaagatggacctctgagtagctaattgattcaagtagtttttttatgttgacacattattactgctgttagcagtcgttttcaccaggtacttacagagcagatttcatacatcattcattcaagggctaaatttatattttttggaaatcatggcaactacacaggatgttgcttaccaggacggagttttggtatcttagtactgaagttagcactatgtttacatgcaaaagattaaggaaaaaacccttaaagtggacaggtatccaaagttcattttctgtgactcatcaaagtgacaaaagacttgtaacaactttgcctggacttttttcattttacaacagttcatccattcacaatgattttgttctctgctccatattttttaatcccttaagcatttgatgaaacactctttagtgctatatgcattttcttacttttgttaaaaatgtgacaattgtcaaaaaatgcactaaaatgtaaatggagattgaacaagttcactttccagcttataggcaactttatacagacttgaacattttctccagttgtttagtaaaagtgaaagagaaagggtttttcctgccacaggatataacttttttttatataacaagcataacacaccactgcttttggtggaaaagtgcagaatagtatgtaccttttatgaagaaaaatgtaatttacaatattcagtgagaatgttactgctgattttcttttccaaggtgtagaatattctttgatttatagaattcatttttgacccagatgatggttcctttacagaacaataaaatggctgaacattttcacaaatagagtgtaacgaagtctggatttctgataccttgtcatttgggggattttattttactttgttgctttaaaattcaatgcagagaagttgttgactgtaggggaaataaagttaattcaaattttg

SEQ ID NO: 1156 - DNA, 100000 bp, Homo sapiens
gagcagtcgtgcattcccagcctcgcctcgggtgtagggattgcatagaaaagcaaaactacacagtcttgactgtgtagttttgtttttaggattagaggctcaccgattcatgtcggagatggtcagaaaaaccaactctccataggacgtcgtttcagaagcaaccttgggcttagtcccaccctttttaggcactcttgagaaatcagtgcctagaaagatgacaactcaagcaccgacgtttacgcagccgttacaaagcgttgtggtactggagggtagtaccgcaacctttgaggctcacattagtggttttccagttcctgaggtgagctggtttagggatggccaggtgatttccacttccactctgcccggcgtgcagatctcctttagcgatggccgcgctaaactgacgatccccgccgtgactaaagccaacagtggacgatattccctgaaagccaccaatggatctggacaagcgactagtactgctgagcttctcgtgaaagctgagacagcaccacccaacttcgttcaacgactgcagagcatgaccgtgagacaaggaagccaagtgagactccaagtgagagtgactggaatccctacacctgtggtgaagttctaccgggatggagccgaaatccagagctcccttgatttccaaatttcacaagaaggcgacctctacagcttactgattgcagaagcataccctgaggactcagggacctattcagtaaatgccaccaatagcgttggaagagctacttcgactgctgaattactggttcaaggtgaagaagaagtacctgctaaaaagacaaagacaattgtttcgactgctcagatctcagaatcaagacaaacccgaattgaaaagaagattgaagcccactttgatgccagatcaattgcaacagttgagatggtcatagatggtgccgctgggcaacagctgccacataaaacacctcccaggattcctccgaagccaaagtcaagatccccaacaccaccgtctattgctgccaaagcacagctggctcggcagcagtccccatcgcccataagacactccccttccccggtcagacacgtgcgggcaccgaccccatctccggtcaggtccgtgtctccagcagcaagaatctccacatcccccatcaggtctgttaggtctccattgctcatgcgtaagactcaggcatccaccgtggccacaggtcctgaagtgcctcccccttggaagcaagagggctacgtggcctcctcatctgaggctgagatgagagagacaacgctgacaacctctactcagatcaggacagaagagagatgggaagggagatacggtgtccaggagcaagtgaccatcagtggtgctgcgggtgctgccgccagtgtgtcggccagtgctagctacgcagcagaggctgttgccactggtgctaaagaggtgaaacaagatgctgacaaaagtgcagctgttgcgactgttgttgctgccgttgatatggccagagtgagagaaccagtgatcagcgctgtagagcagactgctcagaggacaaccacgactgctgtgcacatccaacctgctcaagaacaggtaagaaaggaagcggagaagactgctgtaactaaggtagtagtggccgccgataaagccaaggaacaagaattaaaatcaagaaccaaagaagtaattaccacaaagcaagagcagatgcacgtaactcatgagcagataagaaaagaaactgaaaaaacatttgtaccaaaggtagtaatttccgcagctaaagccaaagaacaagaaactagaatttctgaagaaattactaagaaacagaaacaagtaactcaagaagcaataagacaggaaactgagataactgctgcatccatggtggtagttgccactgcaaagtccacaaaactagaaacagtcccgggagctcaagaagaaactaccacacaacaagatcaaatgcacctaagttatgaaaagataatgaaggaaactaggaaaacagttgtacctaaagtcatagttgccacacccaaagtcaaagaacaagatttagtatcaagaggtagagaaggcattactaccaaaagagaacaagtgcaaataactcaggagaagatgagaaaggaagccgagaaaactgccttgtctacaatagcagttgctactgctaaagccaaagaacaagaaacaatactgagaactagagaaactatggctactagacaagaacaaatccaagttacccatggaaaggtggacgttggaaaaaaggctgaagctgtagcaacagttgttgctgcagtagaccaggcccgagtcagagagcccagagagcctgggcatcttgaagaatcctatgctcagcagaccactttggagtacggatataaggaacgcatttccgccgcaaaggtagctgagcctccccaacgtccagcctcagaaccccacgttgtccctaaagcagtcaagcctagagtaatccaggctccttctgagactcatatcaaaactactgatcaaaagggaatgcacatatcatcacagatcaagaaaactacagatctaacaacggaaagattagtccatgtggataaacgcccccgcacagctagccctcactttactgtttcaaaaatttctgttcctaagacagaacatggatatgaggcatcaatagccggtagtgctattgccacattacaaaaagagttgtcagccacatcttctgctcagaagatcaccaaatcggtgaaggctcctactgtgaagcccagtgagactagagtaagggcagagcccacacccttgccacagttccccttcgctgacacaccagatacttacaagagtgaagctggcgttgaggtgaaaaaggaagtaggggtgagcatcactggcaccaccgtccgtgaagagcgctttgaagtactgcacggacgcgaagccaaggtaacagaaacagcaagagtaccagcacctgttgaaattcctgttactccaccaactttggtctcgggcttaaaaaatgtgactgtcatagaaggtgaatctgtcaccttggagtgccacatctctggatacccatccccgacagtgacatggtacagggaagactaccaaatcgaaagttccattgacttccagataaccttccagagtggaattgctcgtcttatgattcgcgaagcatttgcggaagacagcgggcgatttacttgcagtgctgtaaatgaggctggaaccgtcagcacatcctgctatctggctgtgcaggtgtcagaagaatttgaaaaggaaaccacagccgtgactgagaaatttactacagaagagaaacgctttgttgagtcaagagatgtggttatgactgatactagcctcacagaggaacaagcagggcctggagaacctgccgcgccttactttattacaaaaccagtggtccagaaactggtggaaggtgggagcgtggtgtttggatgccaagttggcggcaacccaaagccccatgtatactggaaaaaatctggtgttcctctaaccactggatacagatacaaagtgagttacaacaaacaaaccggtgaatgcaagctggtgatttctatgacttttgctgatgatgctggagaatacactattgttgttcgcaataagcatggagaaacttctgcatctgcttccttgcttgaagaagctgattatgagttactgatgaagtcccagcaagaaatgctttatcagacacaagtgactgcatttgttcaagaacctaaagttggagaaacagcacctggatttgtatactctgagtatgaaaaagagtatgaaaaagaacaagccttaattaggaagaaaatggccaaagatactgtagtggtcagaacttatgtagaagatcaggaattccatatttcttcctttgaagagagacttattaaagaaattgaatatagaataataaagactacattagaagaacttcttgaagaagatggagaagaaaagatggcagttgacatttctgaatctgaagctgttgaatcaggatttgatttaagaatcaagaattatagaattcttgaggggatgggtgtcacttttcattgcaagatgtctggatatccattaccaaagattgcttggtacaaagatggcaagcgcatcaaacatggagaaagataccaaatggactttctacaagatggcagagctagtctgcgtatacctgttgttcttccagaagatgaaggaatctacactgcatttgccagcaatattaaaggaaatgcaatttgctcagggaaattgtatgtggagcctgctgcaccacttggagctccgacttacattcccacactagagccagtgagcagaatcagatctctctctccacgttcagtgagcaggtctcctatacgcatgtctcctgcacggatgtcacctgcaaggatgtctcctgcacggatgtcccctgcaagaatgtcccctggacgtaggctggaggagacagatgagtcacaacttgagagactatataaaccagtctttgtgttaaaacctgtttctttcaaatgtttagaagggcaaactgccagatttgacttaaaggttgttggtagacctatgccagagacgttctggtttcatgatggccagcaaattgtcaatgactatacccataaagtagtcattaaagaagatggtactcaatcactaattattgtccctgccacacccagtgattctggggaatggactgtggttgcccaaaacagggcaggcagatcttcaatttcagtgattttaactgtggaagctgtggaacatcaggtaaaaccgatgtttgtagaaaaactgaaaaatgtcaatataaaggaaggttcccgacttgaaatgaaagtcagagctacgggtaaccccaaccctgacattgtatggttgaaaaacagtgacatcattgtgcctcataaatatcccaaaatcagaattgaaggaaccaagggagaagctgcccttaaaatcgattccactgtcagccaagattctgcctggtatactgcgactgctattaataaagctggcagagacactacaagatgcaaagtaaatgttgaagttgagtttgcagagcctgagccagagagaaagttaatcatcccacgggggacatatagagcaaaggagattgcagccccagaactggagcccctccatttgcgatatggccaagagcaatgggaagaaggtgatctctatgacaaagagaaacaacagaaaccatttttcaagaaaaaactcacttccttaagacttaagcgctttgggcctgcccactttgaatgcaggctaacacccattggtgacccaacgatggtggtggagtggctccatgatggaaagccacttgaagcagccaacaggctccgtatgatcaatgaatttgggtactgcagccttgattatggcgttgcatattctagagacagtggtatcattacttgcagagccactaacaaatatggaacagatcacacatctgctacccttattgttaaagatgagaaaagtcttgtggaagaatcccaattgcctgaggggaggaaaggcttacagagaattgaagaattagagagaatggctcatgaaggtgcacttacaggtgtaacaacagatcagaaagaaaagcaaaagccagacattgtcttgtacccagagccagttagagtacttgaaggggagactgcaaggttccgctgcagggtaacaggctaccctcagcccaaagtcaactggtacctcaatggacagctcatccgcaaaagcaaaaggttcagagttcgctatgatggtatccattacctggacatcgtggactgcaaatcatatgacacaggtgaagtgaaggtcaccgcggaaaatcctgaaggtgtgatagagcataaagtgaagcttgagattcaacagagggaagattttaggtctgtccttaggagagctcctgaaccaaggcctgagtttcacgtacatgaaccaggaaagcttcagtttgaagtacaaaaagtggatagacctgttgacaccactgaaaccaaagaagttgtgaagttgaaaagggctgaaagaattacccatgaaaaagtgcctgaagagtcggaagagctgcgcagtaaattcaagcgcagaacagaagagggctattatgaagccattaccgctgtggagctcaagtctcgaaagaaggatgaatcctatgaggaactcctcaggaagacaaaagatgaacttctccactggaccaaagagttaactgaagaggaaaagaaagctcttgccgaagaaggcaaaatcacgattccaacttttaaacctgacaagattgaactaagtcctagtatggaggctccaaaaatcttcgaaagaatccagagccaaacagtgggccaaggatctgatgcacacttccgggtcagagtcgtggggaaaccagaccccgaatgtgaatggtacaaaaatggtgtcaaaattgaacggtctgaccggatctactggtactggcccgaagacaatgtttgtgaattggtcataagagatgtgactgctgaggactctgccagcatcatggtaaaagccatcaacatagctggagaaacctccagtcacgcattcttacttgtccaagccaagcaattgatcactttcacacaggaattacaagatgttgttgctaaggaaaaagacactatggcaacctttgaatgtgaaacttcagaaccatttgtcaaagtgaaatggtataaagatggtatggaggttcatgagggagataaatacaggatgcactctgacagaaaggttcacttcctctccatactgaccattgatacgtctgatgctgaagattacagctgtgtacttgtggaagatgaaaatgtcaaaacgactgctaaacttattgttgaaggtgcagttgttgagtttgtgaaagaacttcaggacatagaagttccagaatcatattcaggagaattagagtgcattgtatccccagaaaatatagaaggaaaatggtatcataatgatgtggagcttaaatccaatggcaaatatacaattacatctcgtcgtggacgtcagaacctcacggtcaaggatgtaaccaaggaggaccagggagaatacagctttgtcatcgacgggaaaaagacaacctgtaaattaaagatgaaaccccgccccattgctatcctacaaggacttagtgaccaaaaagtctgtgagggtgacattgttcagcttgaagttaaagtctccttggaaagtgtggaaggcgtctggatgaaagacggccaagaagtgcagcccagtgacagggttcacattgtgatagacaaacaatctcatatgctgctcattgaagacatgactaaggaagatgctggaaattactctttcaccattccagcccttggcctctccaccagtgggcgtgtctctgtctatagtgtggacgtgataacacctctaaaagatgttaatgtgattgaaggcaccaaggctgtgcttgaatgtaaggtgtcagtccctgatgtgacttctgttaagtggtacttaaatgatgaacaaatcaagcctgatgaccgtgtacaggccattgtgaaaggtactaaacagcgactagtcattaaccgaactcatgcttcagacgaaggaccttacaagctgatagttggcagagttgaaaccaactgtaatctctctgtagaaaaaattaaaattatcagaggtcttcgtgaccttacctgtacagaaactcaaaatgtggtgtttgaggttgagctgtcccactctggaattgatgtcctgtggaattttaaggacaaggaaatcaagcccagttctaaatataaaattgaagcacatggaaaaatatataaattgacagttctaaatatgatgaaagatgatgaaggaaaatacacattttacgcgggagaaaatatgacatctggaaaacttactgtggcaggtggggccatctccaagccactcacagatcagaccgtagctgaatcccaggaagctgtgtttgaatgtgaagttgccaacccagattccaaaggcgaatggttgagggatggcaaacacctaccactgactaacaacatcagaagtgagtctgatggccacaaaaggagacttatcattgctgccaccaaattagatgacattggagaatatacctacaaggtggccacctccaaaacatctgccaaactcaaagttgaagctgtcaaaattaagaagactctgaagaacctcacagtgacagaaacacaggatgctgttttcactgtcgagcttacacaccctaatgtcaaaggtgtccagtggatcaaaaatggagttgtgctggaatccaatgaaaagtatgctatctctgtcaaaggaacaatttactctctgaggattaaaaactgtgccatcgtggatgagtctgtttatggcttcaggcttggaaggcttggagccagtgccagactgcacgtggagactgtcaagatcattaaaaagccaaaggatgtgacagccttggaaaatgccactgttgcctttgaagttagtgtttcccatgacactgttccagtaaaatggttccataagagtgtggaaattaagccaagtgacaaacacagactggtctcagaaaggaaagtccacaagctgatgctgcagaacatctccccctcagatgctggggaatacacagctgtggtcgggcaattggaatgcaaagcaaaactgtttgtggagacattacatattacaaaaaccatgaaaaatatcgaggtgcctgagaccaaaactgcctcttttgagtgtgaggtgtcccacttcaatgtcccttccatgtggctgaagaatggtgtggaaattgagatgagtgaaaagttcaagatagttgtgcagggaaaactccatcagctgatcatcatgaacaccagcacagaggactcggcagaatacacatttgtctgtggcaatgaccaagtcagtgccaccctgacagtcaccccaatcatgattacttccatgctgaaagacatcaacgctgaagaaaaagacactattacttttgaggtgacagtgaactatgaaggcatctcttacaaatggttaaagaatggtgtggaaatcaaatcaactgacaagtgccagatgagaaccaaaaagctcacacactcactgaacatcaggaatgttcactttggggatgctgctgactacacctttgtggctggaaaagcaacatcaacagccacactttatgtggaagctcgtcatatagaatttaggaaacacattaaggacattaaggtactggagaagaagcgagccatgtttgaatgtgaagtttctgaacctgacatcactgtacagtggatgaaagatgaccaggaactgcagatcacagacagaataaagattcagaaggagaaatatgtccaccgccttctgatcccatccacccggatgtctgatgctgggaagtacacagtggtggcaggaggcaacgtgtcaactgcaaaactctttgtagaaggcagagatgttcgcatccgaagtattaaaaaggaggttcaggtcattgagaaacagcgtgctgttgttgaatttgaggtcaatgaagacgatgttgatgcccactggtataaagatggcattgaaatcaatttccaagttcaagaacgacacaaatatgtagtggaaagaagaatccaccgaatgtttatctctgagaccagacagagcgatgcaggagaatacacctttgtggcaggaaggaacaggagttctgtcactctctatgtcaatgctcctgaaccgccccaagttctgcaggagctccagcctgtcactgtgcagtctggcaagcctgcccgcttctgtgccatgatatccggaagaccacagcccaaaatttcctggtacaaggaagagcagctgctttccactggcttcaagtgcaaatttcttcatgatgggcaagagtacacgcttttgctaattgaagccttcccagaggatgcggcagtctatacctgtgaagccaagaatgactatggtgttgccacaacatcagcttcactctcagtggaagttccagaagttgtgtctcctgatcaggaaatgcctgtttatccacctgccatcatcaccccgcttcaggacactgtcacttctgaagggcagccagcccgttttcaatgccgggtttctggaacagatctaaaagtgtcgtggtacagcaaagacaagaaaatcaagccatctcggttctttagaatgactcaatttgaagacacttatcaactggaaattgccgaagcttatccagaagatgaaggaacttacacgtttgttgctaataatgctgtaggccaagtatcaagcacagccaacctgagtctggaagctcctgaatcaattttgcatgagaggattgaacaagagattgagatggaaatgaaagagttttctagttcttttctgtctgccgaggaagaaggacttcatagcgccgaacttcaattatctaaaataaatgaaacacttgaacttttgtctgaatctccagtttacccaactaaatttgattccgaaaaggaaggcactggcccaattttcatcaaagaagtgtcaaatgctgatataagcatgggggatgtggctacactgtctgtaactgtcattggcatccccaaacctaaaattcagtggttctttaatggagtgctattaaccccttctgctgactacaaatttgtttttgacggtgatgatcatagcctgatcattctgttcaccaaattggaggatgagggagagtatacatgtatggccagtaatgactatggaaagacaatatgtagtgcctatctaaaaattaattccaaaggagagggtcacaaagacactgaaacagaatcagcagtggcaaaatctctggaaaagctgggaggtccttgtcctcctcacttccttaaggagttaaaaccaattcgctgtgctcaagggcttcctgccatctttgagtacacagtggttggagagcctgcccctactgttacatggttcaaagaaaacaagcagctttgcaccagtgtttattacactatcattcataaccctaatggctctggaactttcattgtcaatgaccctcagagggaagacagtggcctctatatctgtaaagcagagaatatgttgggtgagtccacctgtgcagcagagctgcttgtgcttctggaagacacagacatgactgataccccctgcaaagcaaagtccacaccagaggctcctgaggattttccacagacacccttaaagggtcccgcagttgaagcacttgactcagagcaggaaattgcaacgtttgtaaaagacaccattttgaaagctgctttaattacagaagaaaaccagcaactatcttatgagcatattgctaaagccaatgaattgagcagtcagcttcctttgggagctcaggaattgcaatccattttggagcaagacaagctcactcctgaaagcaccagggaatttctttgcatcaatggcagtattcactttcagcctctcaaggaaccatctcccaacctacagctgcagattgtacagtcccagaaaaccttctccaaagaaggtattctaatgcctgaagagcctgagacacaggcagttctatcagataccgagaaaatcttcccaagtgccatgtccatagaacaaattaattcattaacagttgagcctctgaaaactttattagctgaacctgaagggaattatccacagtcttcaatagaacctccaatgcattcttatctaacctctgtggctgaggaagtactttcaccaaaagaaaagacagtatctgacaccaacagagagcaaagagtgactcttcaaaagcaagaggcacaaagtgcgctcatcttgagtcagagcttagctgagggacacgtggagagtctccagagtcctgatgtcatgatctctcaggtaaactatgagcccctagtcccttcagaacactcatgcacagaaggaggtaaaattttgatagaaagtgcaaatccactggaaaatgcagggcaagattctgcggtcagaattgaggaaggcaagtccttaagatttccactagcacttgaagaaaagcaggtactgctcaaagaagagcattctgacaacgtggtgatgcccccagaccaaatcattgagtctaaaagagagcccgtggcaataaagaaagtgcaggaggtacagggaagggaccttctttctaaggaaagcttgctttctggtattccagaagagcagagattaaacctgaaaattcaaatctgccgggctttgcaagcagccgtggccagcgagcagccaggtcttttctctgagtggctaagaaatattgaaaaggtggaggtcgaggctgtaaacatcacccaagagcccagacacatcatgtgcatgtaccttgttacttcggcaaagtctgtaacagaagaagtaaccatcattattgaagatgttgatcctcaaatggctaacctgaaaatggaacttagggatgctttgtgtgctattatatatgaggaaatagacatcctaacagctgagggtcctagaattcagcaaggagccaaaacaagtttgcaagaagaaatggattctttttcaggttcacagaaggttgaacccattactgaaccagaagttgaatctaaatatctgatctcaactgaagaggtcagttattttaacgtgcaaagtagggttaaatatttggatgccacacctgtcactaaaggggttgcttcagctgttgtctctgacgaaaaacaagatgagagtctgaaaccatcagaggaaaaagaggagtcttcctctgaaagtggtactgaggaggttgctacagtaaagatacaggaagctgagggtggcttaatcaaagaggatggccccatgatacatacacctttagtggacactgtttctgaggaaggtgatattgtacacctcacaacatccataacaaatgctaaagaggtgaattggtattttgagaataaactggtgccttcagatgaaaagttcaagtgtttacaagatcaaaatacatatacgctagtcatcgacaaagtaaataccgaagaccatcaaggagagtatgtctgtgaggccttgaatgacagcggaaaaacagcaacttcagccaaactcactgtagtaaaaagagctgccccagtgatcaagaggaaaatcgaacccctggaagtagcactgggccacctagccaaattcacctgtgagatccaaagtgctcccaatgtccggttccagtggtttaaagctggccgagaaatttatgagagtgacaagtgttctattcgatcttcaaagtatatctccagccttgaaatcctgagaacccaggtggttgactgcggcgagtatacatgcaaagcttccaatgagtatggcagtgtcagctgtacagccacactaactgtgacagaggcatatccaccaacctttctctccagacctaagtcccttacaacttttgtgggtaaggcagccaagttcatctgcacagtgacagggactcctgtgatagaaaccatttggcagaaagatggtgctgcactctcaccttcacctaactggaggatttccgacgcagaaaacaaacacattttagaactctcaaaccttaccattcaagatagaggagtttattcttgtaaggcttctaacaagtttggagcagacatctgccaagcagagttgatcatcattgataagccacatttcattaaagaattagagcctgtgcagtccgctatcaataagaaggtccaccttgagtgccaagtagatgaagacagaaaagtcacagttacgtggagcaaagatgggcaaaaactccccccagggaaagattataagatctgttttgaagataaaatagcaacacttgagattcctttggccaaactgaaagattcaggaacctatgtctgtacagcttcaaatgaggctggaagcagctcctgctcagccacagtcactgtcagagagccaccatccttcgtgaagaaggtggatccctcttatttaatgctcccaggtgaatcagcacgcctccattgcaagctgaaaggctcacctgtgatccaggttacttggtttaaaaataacaaagaactcagtgaaagtaacacagtccgaatgtattttgtcaattctgaggctatacttgatattacggatgtaaaagttgaagacagtgggagttactcatgtgaagcagtgaatgacgtcggcagtgatagctgcagtactgaaatagttatcaaagaacctccttctttcatcaaaactcttgagcctgcagacatagtgagaggaacaaatgctctacttcagtgtgaagtctcaggcactggaccatttgaaattagctggttcaaagacaagaaacaaattcgaagtagtaaaaaatacagattgttttctcagaagtctcttgtgtgtctggagatcttttcgtttaatagtgcagatgttggtgaatatgaatgtgttgttgctaatgaagtcggcaagtgtggctgcatggcaacccacttactcaaagaacctccaacctttgtaaagaaagtagatgatttgattgcactaggaggacaaaccgttaccctgcaagctgctgtgagagggtcagagcccatttctgtcacatggatgaaaggtcaagaggtcatcagagaagacggaaaaatcaaaatgagcttttccaatggtgttgcagtcttgataatccctgatgttcagattagttttggaggcaaatacacgtgcctggctgaaaatgaagctggaagccaaacatctgttggggaattaatagttaaagaacctgccaaaatcattgagcgagcagaactgatccaggtgacagcaggagatcccgccacactggagtacacagtggcaggcacgccagaactgaagcccaaatggtacaaagatgggagacccttggtcgccagtaaaaaataccgaataagttttaaaaacaatgttgcccagctcaaattttattcagctgagctgcacgacagtggccaatacacatttgagatttccaatgaagtgggcagcagctcctgtgagactacattcactgtattagatcgagacattgctccattttttaccaaacccttgcgcaacgtggatagtgttgttaatggtacctgcagactggactgcaaaattgcaggctccctccccatgagggtgtcctggtttaaggatggcaaagaaatagctgcttctgacagatacaggatagcatttgtggaaggcacagcctctttggagatcatcagagtagacatgaatgatgcagggaatttcacttgtcgagccacaaattccgtgggaagcaaagacagcagtggagccctgattgtgcaagaaccacccagttttgtaactaaacccggctcaaaggatgttctgcctggctcagcagtctgcctgaagagcactttccaaggatctactcctctcacaatcagatggtttaagggcaacaaagagctggtttctggtggaagctgctatattaccaaagaagctttagagagttccctggaactctatttagtaaaaacctctgattcgggcacgtacacatgtaaagtcagcaatgtcgctggaggggtggaatgcagtgcaaacttgtttgtaaaagaacctgccacatttgttgaaaagttagagccatcacagctgttaaagaagggagatgccacccagctagcctgcaaagtaactggtacccctccaattaaaataacatggtttgcaaatgatagagaaattaaggagagcagcaaacacagaatgtcttttgtggagtctactgcagttctaagactgacagatgttggcatcgaagacagtggtgaatatatgtgtgaggcccaaaatgaggctggcagtgaccactgcagtagcattgtaatagtcaaagagtcaccttattttaccaaggaatttaagccaattgaagtcttaaaggagtacgatgtcatgttgctggctgaggtggcaggcactcctccctttgagatcacttggttcaaagataacacaatcctgcgaagtggtagaaagtataagactttcattcaggatcatctggttagcctgcagatcctcaagtttgtagctgcagatgctggcgaataccagtgtcgggtgaccaatgaggtgggcagcagcatctgcagtgccagggtgactttaagagaacccccatccttcataaagaagatcgagagtaccagctccctccggggaggcacagctgccttccaggccactctgaagggctccttgccaattacggtgacttggctaaaagacagcgatgaaatcactgaagacgataatataagaatgacctttgagaacaatgtggccagtttgtacctcagtggcattgaagtcaagcatgatgggaaatatgtctgtcaggccaaaaatgatgcaggaatacaaagatgttctgcattactctcagtaaaagaacctgcaacaatcaccgaggaagctgtgtctatagatgtcacccaaggagacccagccactttgcaggttaaattttcagggactaaggagattacagccaaatggtttaaagatggccaagaactgaccctgggctcaaaatataaaatcagtgtcactgatacagtctcaatactgaagattatttctacagaaaagaaagatagtggagaatatactttcgaggtccaaaatgatgttgggaggagcagctgcaaggctagaattaatgtattagatcttatcatacctccttcattcaccaaaaagctgaagaaaatggacagcattaaaggttctttcattgatttagaatgtatagtggctgggtcacatcccataagcatccagtggttcaaagatgaccaagaaatatcagctagtgaaaagtacaaattctcttttcatgacaatactgccttcttggaaatcagccagctggaaggtacagacagtgggacatacacttgttctgccacaaataaggcagggcacaaccaatgcagtgggcatctgacagtcaaagaacccccttactttgtggaaaagccacagtcacaagatgtcaatcccaacacaagggtacagttaaaggctcttgtgggtggcactgcacccatgacaataaagtggtttaaagataacaaagagttacactcaggagcagcccgctcagtttggaaggatgacacctctaccagtctagagctctttgcagccaaagctaccgattctggaacctacatttgccaactaagcaatgatgttggcacagcaaccagcaaagccactctctttgtaaaagaacctcctcaattcattaagaagcccagtccagtcttagtgctgaggaatggacagtcaacaacatttgaatgccaaataacaggcactcctaaaatccgagtgtcttggtatctagacgggaatgaaataacagccattcagaaacatggcatttccttcattgatggtttagccactttccagatttctggtgccagggtagaaaatagtgggacttatgtgtgtgaagctcgaaatgacgcaggcacggcgagctgcagcattgaactcaaagtgaaagaaccccccacctttatcagagagctgaagcctgtggaggtagtaaaatatagtgacgtggagctggagtgtgaagttacgggaacacctccgtttgaagtcacttggctgaagaataacagggaaattcgaagcagcaaaaaatacacattgaccgacagagtgtctgtgtttaacctccatataaccaagtgtgacccttcagacactggggaataccagtgcattgtatccaatgaaggcggcagctgctcatgcagtactagagttgccctgaaagaaccaccatcattcattaagaagatagaaaataccactactgttttgaaaagttctgccacctttcagagtaccgtggcaggttctcctcctatttctataacctggctaaaggatgatcagattcttgatgaagatgataatgtctatatttcatttgtggacagtgtggccacacttcaaatcagaagtgtggataatggacacagtgggagatatacctgtcaagccaagaatgagtcaggagttgagaggtgttatgctttccttttagtacaagaaccagctcaaatcgtagagaaagctaaatcagttgatgttacggagaaagatcccatgaccttggaatgtgttgtggctggaacaccagaactcaaagtgaaatggcttaaagacgggaaacaaatagttcccagtagatacttttcaatgagttttgaaaataacgtggccagttttagaattcagtcagtaatgaagcaggacagcggtcagtacactttcaaggtggaaaatgacttcggaagcagtagctgtgatgcctacttaagagtgctagatcaaaatattcctccatcattcaccaaaaaattaaccaaaatggataaagttctgggctcttctattcatatggagtgcaaggtgtctggttcacttcccattagtgctcagtggtttaaggatggaaaagaaatatctacaagtgcaaaatacagacttgtgtgccatgagagatctgtgtctctggaagttaataatctggaattagaagatactgcaaattacacatgcaaagtgtcaaatgtagcaggagatgatgcatgcagtggcatcttaactgtgaaagaaccaccaagcttcctagtgaaacctgggcgacagcaagccatacctgattctacagtggaatttaaggcaatactaaaaggaacaccaccatttaaaataaaatggtttaaggatgatgtggaacttgtctcaggtcctaaatgtttcattggcttggaagggtcgactagcttcttaaatctctactcagtggatgcttctaagactggacagtatacttgccatgttaccaatgatgttggtagcgactcttgtactacgatgttgcttgtgacagaaccaccaaagtttgtaaagaaattagaagcctccaaaattgtgaaagcaggtgactcttcacgacttgaatgcaagatagctggatccccagaaatcagagttgtgtggttccgaaatgaacatgaacttccagccagtgataagtacagaatgactttcattgactcagtggccgtcatacagatgaacaatctcagtactgaggacagtggagatttcatttgtgaggctcagaatcccgctggcagcacaagctgcagtaccaaggttatagtaaaagagccacctgtttttagcagcttccctcctatagtagaaacccttaaaaatgctgaagtcagtcttgaatgtgaactttcgggaacaccaccgtttgaggtggtatggtacaaagacaagcggcaactcagaagcagcaagaaatacaagattgcatccaaaaacttccacacaagtattcacattctcaatgtggacacttcagacatcggtgaataccactgcaaagcacagaatgaagtgggaagtgatacttgtgtttgtactgtaaaattgaaagaaccaccaagatttgtctccaaactgaacagcctcactgttgtagccggagagcctgctgaattacaagcatccatagaaggcgcccagcctatttttgtccagtggcttaaagagaaggaagaagtgattagagaaagtgaaaacatcaggattacatttgtggaaaatgttgcaactctacagtttgcaaaagcagagccagctaatgctggaaagtatatctgccaaatcaagaatgatggtggaatgagggagaacatggccacactgatggtcttagagcccgcagtcattgttgagaaggcaggaccgatgacggtgactgtaggagaaacgtgcactctggagtgtaaggtggctggcactccggaactctctgttgaatggtacaaggatggaaagctgttgaccagcagccaaaaacacaaatttagcttctacaacaaaatctcttccttaaggattctctcagttgaaaggcaagatgcaggcacatacactttccaggttcaaaataatgttgggaaaagcagctgcacagctgtggttgatgtttcagaccgagcagttcctccctctttcacacgaagactgaaaaatactggtggggtgttaggtgcttcttgcatcttggaatgcaaagtagctggatcatcacctatttcagttgcctggtttcatgagaaaaccaagattgtcagtggagcaaagtaccaaaccacattttcagataatgtctgcacattgcagttgaattctctggattcctcagatatgggcaattacacatgcgtggctgctaatgtcgctgggtctgatgaatgtcgtgcagtgctaactgtacaagaaccaccctcttttgtgaaagaacctgaacctttggaagtactaccaggcaaaaatgtaaccttcacaagcgttattagaggaacccctccattcaaagtcaactggttcagaggtgccagagaactagtgaaaggagaccggtgcaacatctattttgaagacactgtggcagaactggaattatttaatattgacatatctcagagtggggaatacacctgtgtggtttctaacaacgctggccaagcatcttgcactacccgtctctttgtgaaagaaccagctgcatttttgaagagattaagtgatcattctgtagaaccagggaagtccataattctggagagcacctacactggaacacttccaatttctgtcacttggaaaaaggatggttttaacataactacctctgaaaaatgtaacatagtcacaacagagaaaacttgtatcctggaaattctgaatagcacaaaaagagatgcagggcagtattcctgcgagattgaaaatgaggcaggaagggatgtttgtggagctctggtatctacattagaaccgccttattttgttacggaactggaacctctggaggcagcagttggagattcggtttctttacaatgccaagttgctgggacaccagaaattacagtgtcttggtacaaaggagataccaaattacggccaactcctgaatacaggacctactttacaaacaatgtggccacacttgtttttaataaagtgaacatcaatgacagtggagagtacacatgcaaagcagaaaatagtataggaactgcttcttctaagactgtgttcagaattcaagagcgccaactcccaccttcttttgcaagacaattaaaggacattgaacaaactgtggggttacctgttacactcacttgtcgattaaatggctctgcacccatccaagtgtgctggtatagagatggagtacttttaagagacgatgaaaatctacagacttcatttgtagataatgtggcaactttaaaaattttgcaaactgacttgagtcactctggccagtactcttgctcagcttccaacccacttggaacagcatcttctagtgctagactcacagcaagagaacccaagaaatctcccttctttgacatcaagcctgtatctatagatgttattgctggagaaagtgctgattttgagtgtcatgttactggtgctcaaccgatgcgaatcacttggtcaaaagataacaaggagatccgtcctggaggaaactatacaatcacatgtgtgggaaacactcctcatttgagaattcttaaagtaggcaaaggagactctggtcaatatacttgccaagcaaccaatgatgttggcaaagacatgtgctcagctcagctcagtgtaaaagaacctccaaagtttgttaagaaattagaagcttcaaaagttgcaaagcagggagaatccattcaactggaatgtaaaataagtggctccccagaaatcaaagtttcatggttccgaaatgacagcgaacttcatgaaagttggaaatacaacatgtcattcattaattctgtggcattgcttacgatcaatgaagctagtgctgaagacagcggggactacatttgtgaggctcataatggtgttggtgacgccagctgcagcacagcgttgacagtgaaagcacctcctgttttcacccagaagccttctccagtaggagctcttaaaggttctgatgtgattctccaatgtgaaatttcgggaactcccccatttgaagtagtatgggttaaagatcgaaagcaagttagaaacagcaagaaatttaaaatcacttcaaaacattttgatacaagtcttcatatccttaatcttgaagcctccgatgtcggggaatatcactgcaaagctactaatgaggtgggaagtgacacgtgttcttgctctgtcaagttcaaagaacctccacgattcgtgaaaaagctaagtgacacctcaacccttattggggatgctgttgagttacgggccatagtggagggcttccagccaatttctgttgtctggctgaaagatagaggtgaagtcatcagagagagtgaaaataccaggatttcattcattgataacattgcaaccctccagctggggagtccagaagcatctaattctggaaaatatatatgccaaatcaaaaacgatgctggaatgagagaatgctctgcagtcttgactgtactagaaccagcaagaatcatagagaagcccgaacccatgactgtcactactggaaatccttttgcattagagtgtgtagtgactggaacaccagaactctcagccaagtggttcaaagatggaagagaattgtctgcagacagcaaacatcacattacattcatcaataaagtggcttcccttaaaatcccctgtgccgaaatgagtgacaaaggattatatagctttgaagtgaaaaacagtgttggcaaaagtaactgcactgtatccgtccatgtttctgatcggattgtgcctccttccttcatccgcaagctgaaagacgtgaatgccatcctgggggcctcagttgttttggagtgccgagtctctggctcagccccgatttcagttggctggtttcaggatggaaatgagattgttagtgggcccaaatgtcagtccagcttttcggaaaacgtctgtactttgaatctgagcttgttggagccctccgacacaggcatatacacgtgtgtggctgccaatgtagctggttccgatgagtgctcagcagtcctgactgtgcaagaaccaccatcttttgaacaaacccctgattctgtggaagttttgcctggaatgagcctcacattcaccagtgtcatcagaggcacccctcctttcaaggtcaagtggtttaaaggcagcagggaactggtgcctggggagtcatgcaacatctctctggaagattttgtcacagaactggagttgtttgaggtgcagccattagaaagtggagactattcttgcctcgttacaaatgatgctggcagtgcttcctgtaccacacatctttttgtgaaagaaccagccacctttgtgaaaagattggctgatttcagtgttgagacaggaagccccatagttctcgaggccacatacactggcacacctccaatctcagtgagctggataaaggacgagtatcttatttcacaatctgagagatgcagtattactatgacagaaaaatctaccatactggaaattcttgagagcacaatagaggattatgcacagtacagctgcctgatagaaaatgaggctggtcaagatatctgtgaagctctggtgtctgtcttagaaccaccgtactttattgaacctctggaacatgtggaagcagtcattggagaacctgcaactttacagtgtaaagtggatggaactccagaaattagaatttcttggtataaagaacacacaaagctacgatcagctcctgcatataaaatgcaattcaaaaataacgttgcttccttagtaatcaacaaagtggatcacagtgatgtgggagagtattcatgcaaggcagacaacagtgtgggggcagtcgcttcttcagctgtgcttgttatcaaagcgcgcaaacttccacctttctttgcaagaaaactgaaagacgttcatgagactctaggcttcccagttgcatttgaatgccgcatcaatggctcagaacctcttcaagtgtcttggtacaaggatggggttcttttgaaagatgatgctaatttgcagacatcttttgttcataatgtagcaactcttcagattttacaaactgaccagagccacatagggcagtataattgctctgcttctaatcctcttgggactgcttcatccagtgccaagctcattctctcagagcatgaagtgcctcctttctttgatctaaagcctgtatcagtagatcttgctcttggagaaagtggtacttttaaatgtcatgtaactgggactgcaccaatcaaaatcacttgggccaaagataaccgagagattcgccctggaggcaactacaagatgactttggtagaaaatactgccactctgacagttctcaaagtaggcaaaggcgatgccgggcagtacacctgctatgcaagcaacatcgctggaaaagactcttgttctgctcagctgggtgtacaagaaccacccaggttcattaagaagctagaaccttcaagaattgtgaaacaggatgaattcacaaggtatgaatgcaaaatcggtgggtctccagaaatcaaagttttatggtataaggacgagactgaaattcaagagagcagtaaattcagaatgtcattcgttgactcggtggctgtgctggaaatgcacaatctcagtgttgaagacagtggagactacacctgtgaggcccacaatgcagcaggcagtgccagcagcagcacatccttaaaagttaaagaaccacccattttccgcaaaaagcctcatcctatagagacactgaaaggagctgatgttcaccttgaatgtgagcttcagggcactcccccatttcacgtttcttggtataaagacaagagagaacttaggagcggcaagaagtacaagataatgtctgagaacttcctaaccagtatccacatcctgaatgtcgatgctgcagacattggggaatatcagtgtaaagccacaaatgatgtgggaagcgacacttgcgttggttccatcgctctcaaagcaccaccaagatttgtgaagaagctcagtgacatatctactgtcgttggtaaagaagttcagctgcagactaccattgaaggcgctgaacccatttcagtggtgtggttcaaagataagggagaaatcgttagagaaagtgacaacatatggatttcttattcagaaaacattgcaaccttacagttttcaagagtggaaccagccaatgctggaaaatacacttgtcagatcaaaaacgatgctgggatgcaagagtgcttcgccacgctatccgttctcgagcctgcaacaattgtagaaaagccagaatccataaaagttaccacgggagacacctgtaccttggagtgtacagtagctggcacccctgaactcagtactaagtggtttaaggatggaaaagagctaacaagtgacaacaaatacaaaataagcttcttcaacaaagtatctggccttaagatcatcaatgtagcaccgagtgacagtggggtatacagttttgaggtgcagaaccctgttggcaaagacagctgcacagcttcattgcaggtttcagaccgaaccgttcctccttcattcacaagaaaattgaaagagacaaatggtctatccggctcctcagttgtaatggagtgtaaagtctatgggtcacctccaatctctgtctcctggttccatgaaggaaatgagatcagtagtggaaggaaataccagaccaccctgacagataatacttgtgctttaactgtgaacatgctggaagaatcagacagtggtgactacacatgtatagctactaatatggctggttctgatgaatgtagtgctcctttgactgtgagagaaccaccatcttttgttcagaaacctgatcccatggatgttttaactgggaccaatgtaactttcacaagtatcgtaaaaggaacacctcctttcagtgttagctggttcaaaggtagcagtgaactagtaccaggtgacagatgcaacgtgtctttggaggattcagttgctgaactggagttgttcgatgtagatacatcacaaagtggagaatatacttgcatagttagcaatgaagctggcaaggcttcttgtacaacacatctctacataaaagccccagccaaatttgtgaagaggctgaatgattacagcatagagaaaggaaaacccctgatcctagagggtacattcactggaactcctcccatttcggttacctggaagaaaaatggcataaatgtaactccttctcagaggtgtaatataactacgactgaaaaatcggcaatcctggaaattccaagtagcacagtagaggatgcaggacaatacaactgctacattgaaaatgcctctggaaaagattcctgttcagcacaaatactcatactagaaccaccgtattttgtcaagcagttggagccggttaaggtgtctgttggagattctgcctctctacaatgccagcttgctggaacccctgaaattggggtatcctggtataaaggagatacaaaattgagacccactacgacttacaaaatgcattttaggaataatgttgctacactggttttcaaccaggttgatattaatgatagtggagaatatatctgcaaagctgaaaacagcgtgggagaagtttctgcatcaactttccttaccgttcaagagcaaaaacttccaccatcattttctcgacaattgagagatgttcaagaaacagttggactgccagttgtttttgattgtgccataagtggatcagaacctatctccgtgtcttggtataaagacggcaagccattgaaagacagcccaaatgtacaaacatcatttttagacaatacagccacactcaatatttttaaaactgaccggagccttgcaggccagtattcctgcacagctacaaaccctataggctctgcttcttccagtgccaggctcattctcacagaggggaagaacccacccttctttgacatccgtcttgcccctgtggatgctgtggtgggagaaagtgctgactttgagtgccacgtcacgggcacacaaccgataaaggtcagctgggccaaagacagcagagaaatacgaagtggcggaaagtaccagattagttatctggaaaacagcgcccacctgacagtcctcaaagtagacaaaggagattctggacaatatacctgctatgctgtgaatgaagtgggaaaagactcttgcacagctcagctgaatataaaagagcggctcatcccaccaagtttcactaaaagactctcagagacagtagaagaaacagaagggaattctttcaaacttgagggacgtgtggctggttcccaacctataactgttgcctggtacaaaaataatatagagatacaaccaacttctaactgtgaaataacattcaagaacaacacgttagtgctgcaagtcaggaaagcaggcatgaacgacgctggtttgtacacatgcaaagtgtccaatgatgcaggctctgctctgtgcacgtcttcaatcgtcatcaaagaacctaagaagccacctgtatttgatcagcaccttactccagtaacagtgagtgaaggagaatacgtgcagctcagctgccatgtccagggatctgagccaattaggatccagtggttgaaggctggcagggaaataaagccttcagacagatgcagcttcagctttgctagtgggacagctgtactggaactcagagatgtggctaaagcagattcgggagattatgtgtgtaaagcttcaaatgtggctggaagtgacactaccaaatcaaaagtgaccattaaagacaaaccagctgtggccccagcaaccaagaaagctgcggtagatggaagactcttttttgtgtcagaacctcagagtatcagagtcgtagaaaaaaccactgcgaccttcattgcaaaagttggaggtgacccaatcccaaatgttaaatggacaaaagggaagtggagacagctgaaccaaggaggtcgtgttttcatccaccaaaaaggcgatgaagcaaaactggagattagggacaccacaaaaactgattctgggttataccgatgcgtggcatttaacgaacatggtgaaattgaaagtaatgttaacttacaggtggatgaaaggaagaaacaagagaaaattgaaggcgatcttagagcaatgctgaaaaagactccaatcttaaagaaaggagctggagaagaagaggaaattgatatcatggaacttctcaaaaatgttgatcctaaagaatatgaaaaatatgcccgcatgtatggaatcactgacttccgaggtcttcttcaagcatttgaactgctcaagcaaagccaagaagaagagacacatagactggaaattgaggaaatagagaggtcagagagggacgaaaaggaatttgaggaacttgtatcatttattcagcaaagactgtcacagacagagcctgtcactctgatcaaggacattgaaaatcagacagttttgaaagataatgatgctgtctttgaaattgacattaaaattaattatccagaaatcaagctttcgtggtacaaaggaactgaaaaactggaacccagtgataaatttgaaataagcattgatggtgaccgacatacactcagagtcaaaaactgtcaacttaaagaccagggcaattatcgattggtttgtggtccacacatcgctagcgctaaactaactgtaattgagcctgcatgggaacggcatcttcaggatgtgactctgaaagaaggccagacttgcaccatgacatgccaattttctgtaccaaatgtaaaatctgaatggttcagaaatggcagaatccttaaaccccaaggtagacataaaacagaagtggaacacaaagtccataaattgaccattgcagatgttcgagcagaagaccagggtcagtacacctgcaaatatgaagaccttgaaacttcagcagaactcagaatcgaagctgaaccaattcagtttacaaagcgcatacagaacatcgtggtgagtgagcatcagtctgccacctttgagtgtgaagtgtcctttgatgatgccattgtaacatggtacaaaggaccaacagaactgacagagagccagaaatacaacttcaggaatgatggccgctgccattatatgaccatccacaatgtgaccccagacgatgaaggtgtctactcggtcatcgctcggctggagccaagaggtgaagcaagaagcacggcagagctgtacctaacgacgaaagaaatcaaacttgagctgaagcctcctgatattcctgactccagagttccaatcccaaccatgcctatcagagcagtgccaccagaagaaatccctcctgtggttgctcctcctatcccccttttgctaccaacacccgaagaaaagaaaccaccaccaaaacgtattgaagttaccaaaaaggctgtgaagaaagatgccaaaaaagttgttgcaaagcccaaagagatgacaccacgtgaagagattgtcaagaagcctccacctcctactaccttaattccagcaaaagctcctgaaatcattgatgtatcctctaaagctgaagaagtaaaaataatgactataaccagaaagaaagaggttcagaaagaaaaagaagctgtgtatgagaaaaagcaagcagtccacaaggagaagagagtcttcattgaatctttcgaagaaccttatgacgaactggaggtagaaccatacacagagccatttgaacaaccttattatgaagaaccagatgaagactatgaagagattaaggtagaagctaaaaaagaagttcacgaggaatgggaagaagattttgaagaagggcaagaatactatgaaagggaagaaggctatgacgaaggggaggaagagtgggaagaggcttaccaagaaagggaagtaattcaagttcaaaaggaggtctatgaagaatcacatgagagaaaagttccagccaaagtacctgaaaagaaagcaccaccacctcctaaagttataaagaagccagtaattgaaaaaattgaaaagacttctcgaagaatggaggaagaaaaagttcaagtcaccaaagtacctgaagtttcaaagaagattgttccacaaaaaccttcccggactccagtacaggaagaagttattgaagtgaaagtaccagctgtgcatacaaagaagatggttatttcagaagaaaagatgttctttgcttctcacacagaggaggaggtgtcagtcacagtccccgaggtacaaaaggaaattgttactgaagagaaaattcacgttgccatttccaaaagggttgaaccaccacctaaagtccctgagctacctgagaaaccagctccagaagaagtggcccctgttcctatccctaaaaaagtggagcccccagcaccaaaagttcctgaggttcccaagaaacccgtgccagaggagaaaaagccagttcctgtgcctaagaaggaacctgctgctcccccaaaagtcccagaggtgccaaagaaacctgtccctgaagaaaagattcccgttcctgttgcaaagaaaaaggaagctcccccagctaaagttcctgaagtacagaagggagttgtgacagaagaaaaaataaccattgtaactcaaagagaggaatctccaccaccagcagtgccagaaataccaaagaagaaagttcctgaagaaaggaaacctgttcctcggaaggaggaagaagttccaccaccaccaaaagtgccagctctgcctaagaaacccgtcccagaggagaaagttgcagtgccagttcctgtcgctaagaaagctcctcctccccgagctgaagtctctaagaaaactgttgtagaagaaaagagatttgttgctgaagaaaaactatccttcgcagttcctcaaagagtggaagtcacgcggcacgaagtatctgcagaggaggaatggagttactcagaagaggaggaaggtgtgtccatttcagtttatagagaagaagaaagagaggaggaggaagaagcagaggttacagaatatgaagtgatggaagagcctgaggaatatgttgtggaagaaaagctgcacattatttctaagagagtggaagctgagccagctgaagtgacagagaggcaggagaagaaaattgtactgaaaccaaaaattcctgctaaaatagaggagcctccaccggctaaagttcctgaagcacctaagaaaattgtgccagaaaagaaagttcctgctccagttcctaaaaaggaaaaggtgcccccacctaaagtgccagaagagccaaagaaaccagttccagaaaaaaaggttcctccaaaagtcattaagatggaagaacctctcccagccaaagtgactgagaggcacatgcaaattacccaggaagaaaaagttcttgttgctgtaactaaaaaagaggcgcctccaaaagcaagagtgccagaggaaccgaagagagctgtcccagaagaaaaagttctgaaactcaaacctaaaagagaggaggaaccaccagctaaagtgactgaattcagaaaaagagtggttaaagaagaaaaagtatcaattgaagctccaaaaagagaacctcaacccatcaaagaagtaactataatggaagagaaagaaagggcttataccctagaagaagaagctgtttcagtacaacgggaagaagaatatgaggaatatgaagaatatgattataaagaatttgaggagtatgaaccaacagaagaatatgaccaatatgaagaatacgaggagcgggagtatgaacgatatgaagagcatgaagaatacatcacagaaccagagaagcctatccctgtaaagcctgtcccagaagaaccagttcccacaaaaccaaaggccccaccggctaaagtgctgaagaaagctgtccctgaagaaaaagtaccagtgcccattcctaagaaactcaaacctccaccacccaaagtgcctgaagaaccaaagaaagtttttgaggaaaaaatacgtatttcaattaccaaacgtgaaaaagagcaggtgactgaacccgctgctaaagtgcccatgaagcccaagagggttgtcgcagaagaaaaagtacctgtccctagaaaagaagtagcaccacctgttagagtgccagaagtgcctaaagaacttgaaccagaagaggttgcctttgaagaggaagttgtaacccatgtagaagaatatcttgtagaagaagaagaagagtacattcatgaagaagaggagttcataactgaggaagaagtggtgccagtgataccagtcaaagtgcctgaggtacccaggaaacctgttccagaagagaagaaacctgttcctgttcccaagaagaaggaagctccaccggcaaaagtgcctgaggttcctaagaagccagaggagaaagttcctgtgcttattcctaaaaaggagaagcctccgccagcaaaagttcctgaagtgcccaagaaacctgtgccagaggagaaagtaccagtaccagttcctaaaaaggtggaagctccacctgccaaagtgccagaggtacccaagaagcctgtgcctgagaagaaggtgccagttcctgctcctaagaaagtggaggctccacctgcaaaagtgccagaggtgcccaagaagctcatcccagaagaaaagaaaccaacacctgttccgaaaaaagtggaagcaccaccacccaaagtgccaaagaaacgtgaaccagttccagttcctgtagctctacctcaggaagaggaagttctatttgaagaagaaattgttcctgaagaggaagttctacctgaggaagaggaagttctacctgaggaagaggaagttctacctgaagaagaggaagttctacctgaagaagaggaaattccacctgaggaagaggaagttcctcccgaagaagaatatgtacctgaggaagaagaatttgtacctgaagaagaagtccttccagaagttaaacctaaggtgccagtacctgcaccagtgcctgaagtgccaaagaaacctgtaccagagaagaaagtccctgttcccgcccctaaaaaagtggaacctccaccaccacccaaagtgcctgaaattaagaagaaagtgacagagaagaaagtggtcattcccaagaaagaggaggctccccctgccaaagttcctgaggtgcctaagaaggtggaagaaaaacgaatcattctccctaaagaagaggaagttctaccagttgaagtgactgaggagcctgaagaagagcctatttcagaagaagaaatcccagaagaaccacctagcatagaggaagttgaagaggtggcaccacctagagtgcctgaagtgattaagaaagcagtacctgaagcacctactcctgttcctaaaaaagtggaggcaccaccagctaaagtgtcaaagaaaattcctgaggaaaaagtacctgttcctgttcagaaaaaagaggcacccccagccaaagtgcctgaagtaccaaagaaagtcccagaaaagaaagtccttgtgcctaaaaaggaagctgttcccccagctaaagggagaactgtccttgaagaaaaagtatcagttgccttccgccaagaagtagtagtaaaagaaagactagaattagaagtagtagaagcagaagtggaagaaattccggaagaagaagagttccatgaagttgaagaatattttgaagaaggcgagtttcatgaagtagaagaattcatcaaattagaacaacatagagttgaagaagaacacagagttgaaaaagttcatagggtaatagaagtttttgaggctgaagaagtggaagtatttgaaaaaccaaaagctccacctaaagggcctgagatatctgagaaaatcatccctccaaaaaaaccgcccactaaagttgttcctcgaaaagagccaccagctaaagtaccggaggtgcctaagaaaattgtggtagaagaaaaagtacgtgttcctgaagagcccagagttccaccaactaaagcacccgaagtacccaagaaaattgtcccagaagaaaaagttcgtgaagctgttctgaaaaagcctgaagttccaccagctaaagtacttgtgactcaacctcaaaagacaaaacccaaactagcaaaagtgcctgagccacccaagaaagttgttccagaagacaaaatatatgtgactattcctaaaaagagagaaacaccagcaactaaagaacctgatacaaccagaggcatttttccagaggtggagccacctgaggctattcctgaaattccagaacatcctccaactgaagagtttgaagtcttcaaggaagtcattccagagggagaaactcctattgttaaaagaagaaaaacaccatcaccaacagcaccagaagctatgaaagaagttgtccctgaaatgaaaatatttgaggatgtacctgaagagccagaaactccacgtatgaaaacgcccgaagctcctcaagaaattattcctgccaagacagttccttccaaaaaaagagaacccccatcagttaaagtgcctgaagctctccaagaaattgtccctgaaaagaaaacgcttgtggttcctctcagaaagcctgaagtccttcctgatgaagtgccggaggctctcagagaagttgtcccggaaaagaaagtgcatcctccccaaagggctgaagttgtacctgtcaaagtgcacgaagctcccaaagagattatccctgaaaagaaagtgtcggtggtgcctcctaaaaagcctgaagtcccacctgttaaagtgccagaagcttccaaagaggttatccgcgaagagaaagtgcccttggctcctcctaaagagcctgaagtcccacctgttaaagtaccagagcctcccaaagaagtagttcctgaaaagaaagcgccagtggctcctcctaaagagcctgaagtcccacctgttaaagtgcctgaggctcccaaagaagttgttcctgaaaagaaagtgccagtgcctcctcctaaaaagcctgaagtgccacccacaaaagtcccagaggtgccaaaggcagctgtcccagaaaagaaggtgcctgaagctattcctcccaaaccggaaagtcctccccctgaagtgcctgaagtgctgccaccgaaggaagtggtcccagaaaagaaagtaccggtgcctcctgccaaaaagccagaagctccacctcctaaagttcctgaagctcctaaagaagttgtacttgaaaagaaagcatctgtggctgtgcccaaaaaaccggaagccccacgtgcaaaagtgcctgaagctgctcaagaagttgtcccagaaaagaaaattcccaaggcaccaatcaaaaaaccagaagcccccgcagttacagtgccagaagttcctcaagaagccgcagaaaaagaaattcccgtggctccacccaaaaaaccagaagctccaattgtcccagtgcctgaagtcccacaagaaattgtgccagaaaagaaaacactggtgcttcctaaaaagccagaagttccacctgttacagtgccagaggctcccaaagaagttgtccttgaaaagaaagtgcccttggctcctcctaaaaagcctgaagtcccacctgttaaagtgccagaggctcccaaagaagttgttcctgaaaagaaagtgccagtgactcctcctaaaaaacctgaagtcccacctgttaaagtgccagaggctcccatagaggttgttcctgaaaagaaaatgcccttggctcctcctaaaaagcctgaagtccctcctgttaaagtaccagaggctcccaaagaggttgttcctgaaaagaaagtgccctcggctcctcctaaaaagcctgaagtcccacctgttaaagtgccagaggctccgaaagaagttgttcctgaaaagaaagtgccagcggctcctcctaaaaagcctgaagtcacacctgttaaagtgcctgaggctcccaaagaagttgttcctgaaaagaaagtgccagtgcctcctcctaaaaagcctgaagtgccacccacaaaagtcccagaggtgccaaaggtagctgtcccagaaaagaaggtgcctgaagctattcctcccaaaccggaaagtcctccccctgaagtgttcgaggagcctgaggaagttgccctagaagagcctcctgctgaagttgtggaagagccagagccagcggcgcctccacaagtgaccgtaccacctaagaaacctgtcccagaaaagaaagcacctgctgtcgttgccaaaaaacctgaactaccaccagtgaaagtgcccgaggtgcccaaggaggttgttcctgaaaagaaggtgcctctggtggttcccaaaaagccagaagccccacctgctaaagtgcctgaagttccaaaagaagttgttccagaaaagaaagtagctgttcccaaaaagccagaagtcccaccagcaaaagtgccagaagtgccaaagaaacctgtcttggaagagaaaccagctgttcctgttccagaaagagcggagtctcctcccccagaagtatatgaagaacctgaggaaattgctcctgaagaggaaattgctcctgaagaggaaaagccagttcctgttgcagaagaggaggaaccagaggttccacctccagcagtgcctgaagagcccaagaagatcatcccagagaagaaagttcctgtcatcaaaaaaccagaagcaccgcctcctaaagaacgtgaaattgaaaagtatattaaacctgaagagcccgaacctgaaccacagcctgaagaaataccagtaaaagaacctgaacctgaaaaggttattgagaagccaaaactcaaaccaagacccccacctcctccacctgctccacctaaggaagatgtgaaggagaaaatattccaacttaaagctattccaaagaagaaagttcctgaaaaacctcaggttccagaaaaagtggagcttacacctctgaaagtgcctggaggtgaaaagaaagttcgcaaattacttccggaacgtaaacctgaaccaaaggaagaagttgttctgaaaagcgttctaagaaaaagacctgaagaagaagaacctaaagtagaacctaaaaaactagaaaaagttaaaaaacctgcagtaccagaaccaccacctccaaaacctgttgaagaggttgaagtacctactgttacaaaaagggaaaggaagattcctgaaccaacaaaagtgcctgaaatcaagccagcaatacctctccctgcacctgaaccgaaaccaaagcccgaagcagaagtgaaaacaatcaaaccacctcctgtggaacctgaaccaacccccatcgctgccccagtaacagtgccagtggttggaaagaaagcagaagccaaagcacctaaggaagaggctgccaagccaaaaggtcctatcaaaggtgtacccaaaaagactccttcaccaatagaagccgaaaggagaaagttaaggccaggaagtggtggagagaaacctcctgatgaagccccgttcacctaccagctaaaggctgtgccactgaagtttgtgaaagaaatcaaagacatcatcttgacagaatcagagttcgttggctcttcagcaatctttgaatgtttggtctccccttccactgcaattacaacctggatgaaagacggtagcaatatccgtgagagtcccaagcacaggtttattgcagatggtaaagacagaaagctgcacatcattgatgttcaactttccgatgctggtgaatacacctgtgttttacgtttgggaaacaaagaaaagacctccacggctaaacttgttgtagaagaacttcctgtgcgttttgtaaaaacactggaagaggaagtcacagtggtcaaaggacagccattgtacttgagctgcgagttaaacaaagagcgtgacgtggtctggaggaaggatggcaagattgtggtggagaaacctggccgaattgtgccaggcgtcattggcttgatgcgggctctgaccatcaacgatgcagatgacacagatgctggaacatacacagttactgtggaaaacgccaacaacctggagtgttcatcttgcgtaaaagtagtagaagtcattagagattggctggtgaaacctatacgagaccagcatgtgaaacccaaggggacagctatttttgcctgtgatatagcaaaagatactccaaacattaagtggttcaaaggatatgatgaaatccctgcggaaccaaatgataagactgaaatactgagagatggaaatcatctgtacctcaaaattaagaatgctatgccagaagatattgctgagtatgcagtggaaattgaaggaaaaagataccctgcaaagctgacacttggagagcgtgaagttgaactgcttaaaccaatagaggacgttaccatttatgagaaagaaagtgcaagctttgatgcagaaatctcagaggcagacattcctggacaatggaaactgaaaggagaacttctaaggccctcacctacttgtgaaatcaaagcagaaggtggaaaacgcttcttaactttgcacaaagtcaaactggaccaagctggtgaagtcctctaccaggcccttaatgcaattacaactgccattttgacagtaaaagaaatcgaacttgactttgctgtgcccctgaaggatgtcactgttccagaaaggcgacaggctcgattcgaatgtgtcctcacccgagaggcaaatgttatatggtccaaaggacctgatataattaagtcatctgacaaatttgatatcatcgctgatggaaagaaacatattcttgttattaatgattctcaatttgatgatgaaggggtctatactgctgaggtggagggcaagaagacctcagctcggttgtttgtcacaggtataagactgaaattcatgtcacctcttgaagatcaaacagtaaaagaaggtgaaacagcaacttttgtttgtgaactttctcatgaaaaaatgcatgtagtctggttcaaaaatgatgccaaactccatacaagcagaacagtactcatctcttctgagggcaagactcacaaattggaaatgaaagaagtgacattggatgatatatctcagataaaagctcaagtcaaggagctgagctccacagcacagctgaaggtcttagaggccgatccctacttcactgtgaaattacatgacaaaactgcagtggagaaggatgagattactttgaagtgtgaagtgagcaaagatgtaccagtgaaatggttcaaagatggtgaagagattgtcccttcacccaaatattctatcaaggcagatggcctgcgccgcatcttaaaaatcaaaaaggcggaccttaaagataaaggcgaatatgtgtgtgactgtggcacagacaagaccaaggcaaatgttactgttgaggctcgactaataaaagtggaaaagcctctgtacggagtagaggtgtttgttggtgaaacagcccactttgaaattgaactttctgaacctgatgttcacggccagtggaagctgaaaggacagcctttgacagcttcccctgactgtgaaatcattgaggatggaaagaagcatattctgatccttcataactgtcagctgggtatgacaggagaggtttccttccaggctgctaatgccaaatctgcagccaatctgaaagtgaaagaattgcctcttatcttcatcacacctctcagtgatgttaaagtcttcgagaaagatgaggctaagtttgagtgtgaagtatccagggagcccaaaacattccgttggctaaaaggaacccaggaaatcacaggtgatgacagatttgagcttataaaggatggcactaagcattcaatggtgatcaagtcagctgcttttgaagatgaagcaaaatacatgtttgaagctgaagataagcacacaagtggcaaactgatcattgaaggaatccggctcaaattcctcacccctctcaaagatgtaactgccaaagagaaggaaagtgctgtatttactgtggagttatctcatgataacatccgagttaaatggttcaagaatgaccagcgcctacacaccaccaggtcggtctcaatgcaagacgaagggaaaactcattcgatcacattcaaagacctgtctattgatgacacctcccaaattagagtagaagctatggggatgagttcagaagctaaactcactgtgcttgagggagacccatattttacaggaaaacttcaagattatactggtgtagagaaagatgaagttattctacagtgtgaaattagcaaagcagatgcaccagtgaaatggtttaaggatgggaaggaaataaagccatccaaaaatgctgttattaaggcagatggcaagaaacgcatgctaatcctaaagaaagccttgaaatcagatattggacagtacacctgtgactgtgggacagataagacctcaggaaaacttgacattgaggatcgggaaattaaactggtgcgacccctgcacagtgtggaggtgatggagactgagacagcacgctttgaaaccgaaatctctgaagatgatatccacgccaactggaaactcaagggagaggccctactccaaacacctgattgtgaaattaaggaagaaggcaaaatacactcccttgttttgcacaactgtcgcctggaccagacgggtggggtggatttccaagctgccaatgttaaatctagtgcccacctccgagttaagccacgagtaattggtcttctgaggcctttaaaggatgtcaccgtgactgcaggggaaacagccaccttcgactgcgagctctcctacgaagatatcccagtggaatggtatctcaaagggaagaaactagagcccagcgataaggtggtcccacgttcagaaggaaaagttcatacacttactctgagggatgtaaagttagaagatgctggggaagtccaactaacagcaaaagatttcaaaactcacgccaacctctttgtgaaagaacccccagttgaattcactaagcctcttgaggaccagacggtcgaagagggagccactgcagtgctggagtgtgaagtctccagagaaaatgctaaggtgaaatggttcaaaaatgggacagaaatcctcaaaagcaagaagtatgaaattgttgctgatggcagggtcagaaaacttgttatacatgactgtaccccagaggatattaaaacatacacttgtgatgctaaggattttaagacttcctgtaacctgaatgtcgtgcctcctcatgtggaattcttaagaccactcaccgaccttcaagttagagaaaaagaaatggctcgatttgagtgtgaactttcccgagaaaatgctaaggttaagtggtttaaagatggtgctgaaattaaaaagggcaaaaaatatgacatcatatccaagggagcagtgcgcattcttgtcatcaacaaatgtctactggatgatgaagctgaatattcctgtgaagtaaggacagcgagaacttctggcatgctgacagttctggaagaagaagctgtctttaccaaaaatcttgccaacattgaagttagtgaaacagacactataaaactggtttgtgaagtctccaaacctggcgcagaagtgatttggtataaaggggatgaggagatcattgaaacaggaagatatgaaatactgactgaaggacggaagagaatcctggtcattcagaacgctcaccttgaggatgctggcaactacaactgtcgactcccaagctctcgaaccgatggcaaagtcaaagtacatgaactggctgctgaatttatctcaaagcctcaaaaccttgaaatacttgaaggagaaaaggctgaatttgtctgctctatatcaaaagaaagctttccagtccagtggaagagggatgataagacacttgaatctggagataaatatgacgttattgctgatggtaaaaagagggtcctagttgtgaaagatgccacattacaagatatgggcacttacgttgtcatggtaggggccgccagagcagcagctcacttgacagtcattgaaaaactcaggatcgtagttcctcttaaggacacccgggtgaaggaacaacaggaagttgtcttcaactgtgaagtcaatactgaaggtgccaaagccaaatggttcagaaatgaagaagctatatttgatagttcaaaatacatcattctccaaaaagacctagtctacaccctcagaattagagatgcacacttagatgaccaagccaactataatgtgtctttgaccaatcacagaggtgaaaatgttaaaagtgcagccaatctaatagtagaagaggaagaccttaggattgttgagcctcttaaagatattgaaacaatggagaagaaatctgtcacattctggtgcaaggtgaatcgtctcaatgtaacactgaagtggaccaaaaatggtgaagaagtgccttttgacaaccgtgtctcatacagagttgataagtacaagcacatgttaaccattaaagactgtggcttcccagatgaaggtgaatacattgtcactgctggacaagataaatctgttgctgagcttctcatcatagaagccccgacagaatttgtggaacacttggaagatcagacagtcactgagttcgatgacgctgtcttctcctgccagctctccagagagaaagccaatgtaaaatggtacagaaatgggagagaaatcaaagaaggcaaaaaatacaaatttgaaaaagatggaagtatacacagactcattataaaagattgcaggctggatgatgagtgtgaatatgcttgcggggtagaagacaggaagtctcgtgctagactttttgtggaagaaattcctgttgagatcatcaggcctccacaagatattcttgaagcccctggtgctgatgttgtctttttagcagaactcaataaagataaggtggaagtccaatggctaagaaataacatggttgttgtccagggtgataaacaccagatgatgagtgaaggaaagatacatcgactacagatttgtgatattaagccccgtgaccagggtgaatacagatttattgccaaagacaaagaagccagagctaagcttgaactggcagctgcaccaaaaatcaagacagctgaccaagaccttgtggttgatgttggcaagcctctgacaatggtggtgccatatgatgcctaccccaaagcagaagctgaatggtttaaagaaaatgaacctttatctacaaaaaccattgatactacggctgaacaaacttctttcagaattttagaagccaagaaaggagacaaagggaggtataaaattgtgcttcagaacaaacatggaaaagcagaaggattcatcaatttaaaagttattgatgttcctgggccagtacgtaacttagaagtgacagaaacatttgatggtgaagtgagccttgcttgggaagaacctttaactgatggtggaagcaaaatcataggttacgttgttgaaagacgtgacattaagagaaagacctgggttctggccacagaccgtgcagagagttgtgagtttactgtcactggtctacagaaaggaggagttgagtacctattccgtgtgagtgcaagaaacagagttggcactggtgagccagtagaaactgacaatcctgtagaagcaaggagtaaatatgatgttccaggccctcctttgaatgtaaccatcactgatgtgaatcgatttggtgtctcactgacatgggaaccaccagagtatgatggaggtgctgagatcacaaactacgtcattgaattaagagacaagacttctatcaggtgggatactgccatgactgtgagagctgaagacctgtctgcaactgttactgatgtggtagaaggacaggagtacagtttccgagtgagagcccaaaatcgaattggagttggaaaaccaagtgcagccacacccttcgtcaaagttgctgatccaattgagagaccaagtcctcctgtaaacctaacttcctcagatcagactcagtcatcagttcagctcaaatgggaacctcctctgaaagatggaggaagcccaatattaggctatataattgagcgatgcgaagaaggaaaagataattggattcgttgcaatatgaaacttgtccctgaactgacttacaaggttaccggattggaaaaaggaaataaatatttatatagagtatctgcagaaaataaagctggtgtttcagatccatctgaaattcttggtcctctcaccgctgacgatgcatttgttgaaccaacaatggatttaagtgcatttaaagatggtctggaagttattgtcccaaatcctatcacgatcctggttccaagtacaggctatccaaggccaactgcaacctggtgttttggagataaagtactagaaacaggggaccgggtgaaaatgaagaccttgtctgcctatgccgaacttgtcatttctccaagtgaacgttcagacaagggcatttatacactgaaattagaaaaccgtgtgaaaacaatttctggggaaattgatgtcaatgtaattgctcgcccaagtgcacccaaagaattgaaatttggtgatataaccaaggactcagtacatttgacttgggaaccacctgatgatgatggaggaagtccgttaactggatacgttgttgaaaaacgagaagtcagccggaaaacatggactaaagttatggactttgtgactgatctagaattcacagttcctgatcttgttcaaggaaaagagtacttatttaaagtttgtgctcgtaacaaatgtggccctggagaacctgcatatgttgatgaacctgtaaatatgtcaactcctgcaacggtacctgacccaccagagaatgttaaatggagagatcgaacagccaatagcatcttcttaacatgggatccacctaaaaatgatggtggttcacgcatcaaaggatatatagttgaaagatgtccacgtggttctgataaatgggttgcctgtggagaacctgttgcagaaacaaaaatggaagtgacaggtcttgaggaaggcaaatggtatgcctaccgcgtgaaggccttaaacaggcagggtgctagcaaaccaagcagacccacagaggaaatccaggctgtggacacacaagaggccccagaaatcttcctcgatgtgaagctccttgctggtctcactgtaaaagctgggaccaagattgaacttcctgccaccgtaaccggaaaacctgaacctaaaataacttggacaaaggctgatatgattctgaagcaggacaaaagaattaccattgaaaatgtccctaagaaatccacagtgactattgttgatagtaagagaagtgacactggcacatatatcattgaggctgtgaatgtgtgtggccgggccactgctgtggtggaagtgaacgtcttagataaacccggaccaccagctgcctttgacatcacagatgtaaccaatgagtcatgtcttctaacatggaacccaccacgcgatgatggtggatctaagatcacaaactatgttgtggagagacgagcaactgatagtgaagtgtggcacaagctctcatccaccgtcaaggatacaaacttcaaggccaccaaattaatccccaataaagagtacatcttcagagttgctgcagaaaacatgtatggtgttggtgaaccagttcaggcctctccaataacagccaaatatcagtttgatccacctggtcctccaactcgcctagaaccttctgatatcactaaagacgcagtgactctcacatggtgtgagccagatgatgatggtggcagcccaatcacaggatactgggttgaaagactggatcctgatacagataaatgggttagatgcaataagatgccagtaaaggacacaacatacagagtgaaaggtctcactaataagaaaaaatacagattccgtgtgttggctgaaaatcttgctggacctggaaaaccaagcaaatcaactgaaccaatcttaataaaggatcccatagatcctccatggccccctggaaaaccaactgtaaaagatgtaggcaaaacatcagtaaggttgaattggacaaaaccagaacatgatggaggtgcaaagattgagtcttatgtcattgaaatgctgaagactggaacagatgagtgggtcagagtggcggaaggggttcccaccactcagcacttgctcccagggctcatggaaggacaggaatactcattccgagttagagctgtgaataaggctggggaaagtgaacccagtgaacccagtgaccctgtgctttgccgggagaagctatatcctccatcaccaccacgctggcttgaagttattaatatcacaaaaaatacagcagacctaaaatggacagttcctgagaaagatggagggtcccccatcaccaactacattgtggaaaagagagacgtcaggcgaaaaggctggcaaacagtggataccactgtcaaggacaccaagtgcacagtcaccccactgactgagggctctttatatgtgttccgagttgctgcagaaaatgctataggacaaagcgactacaccgaaattgaggactctgtgctggccaaagacacctttaccactcctggaccaccctacgccctggcagtggttgatgtgacaaaacgacatgttgacctaaagtgggagccacctaaaaatgatggtggaagaccaatacagagatatgtcattgagaagaaagaaaggttaggtacccgttgggtgaaagctggaaagactgcaggacctgactgtaacttcagagtaactgatgtcatcgaaggaacagaggtccagtttcaggttcgggctgaaaatgaagctggagttggccacccaagtgaacccacagaaatcctatccattgaagatccaacaagtcctccctcaccaccccttgacctacatgtgactgatgctgggagaaaacacattgccattgcttggaagcctccagagaaaaatggtggaagtcctatcataggataccatgttgaaatgtgtccagtaggcactgagaaatggatgagagttaattctcgcccaataaaggacttgaaattcaaggttgaagaaggtgttgttcctgacaaagaatatgtcctgagagtgagagcagtcaatgctattggtgtcagcgagccatctgaaatctctgaaaatgtggttgccaaagacccagactgcaagccaacaattgacctggagactcatgacattattgttattgaaggtgaaaagttaagcattcctgttcccttcagagctgtcccagttccaactgttagttggcataaagatggcaaagaagttaaagcaagtgatagattaacaatgaagaatgatcacatctctgcacaccttgaagttcccaagagtgtccgtgcagatgccggaatttataccattacactggagaataagctcggctcagcaacagcctcaatcaatgtcaaagtcataggcctacctggaccatgcaaagatattaaagcaagtgacattaccaagagttcttgtaagttaacttgggaacctccagaatttgatggtggaaccccaattcttcattatgtcctggagcgcagagaagctgggaggagaacatatataccagtcatgtctggtgagaacaaactgtcatggactgtgaaggatctcataccaaatggtgaatacttcttccgtgttaaagcagtcaacaaggttggtggaggagaatatattgaactgaaaaatccagtcattgctcaagatccaaagcaaccccctgatccacctgtagatgtagaggttcataatcctacagcggaggcaatgactattacatggaagccacctttgtatgatggagggagcaagataatgggctacatcatagagaagattgctaagggtgaagaaaggtggaagagatgcaatgaacacctggtaccaatcctgacctatacagcaaaaggacttgaagaggggaaagagtaccaattccgtgtgcgagcagagaacgccgcgggtattagtgaaccttctcgggctactcctccaaccaaagctgtagatcccattgatgcccccaaagtcattctgagaacaagcctagaagtgaaacgaggtgatgaaatagcacttgatgcaagtatttctggatcaccttacccaactattacatggataaaggatgaaaatgttattgtaccagaggaaattaagaagcgtgcagcacccttggttaggagaaggaagggtgaagttcaagaagaagaaccatttgtcctgcctctgacacagcgtttgagtattgacaacagcaaaaagggagaatctcagctacgcgtccgagattctctccgacctgaccatggtctgtatatgatcaaagttgaaaatgaccacggtattgcaaaagctccttgtactgtcagtgtgttagatacaccgggaccaccaatcaactttgtatttgaagatatcagaaagacctcagtcctttgtaaatgggaaccaccccttgatgatggtggcagtgaaatcataaactacactttggaaaagaaagacaagacaaaacccgactcagaatggattgttgtcacttcaacacttagacattgcaaatattcagtaacaaaactgattgaaggaaaagagtacctcttccgtgtaagagctgaaaacagatttgggccaggtccaccatgtgtttcaaagccacttgtggctaaagatccatttggaccacctgatgcaccagataagcccattgtggaagatgttaccagcaacagtatgctagtgaaatggaatgaaccaaaagataatggaagccccattttgggttactggcttgaaaaacgtgaagttaacagtacacattggtctcgtgtcaacaaaagccttctgaatgccttgaaagccaatgtagatggcttattagaaggactcacctatgtcttcagagtatgtgctgaaaatgcagctggacctggaaagttcagtccaccttcagatcccaaaacagcacatgatccaatctctcctcctgggccacctatcccaagagtcactgacacaagctctacaactattgaactagaatgggaacccccagctttcaatggtggtggggaaattgttggctattttgttgataagcagttggttggcacaaatgaatggtcacgctgcacagagaagatgatcaaggtccgtcagtacaccgtcaaagaaatccgagagggtgctgattacaaacttcgggtgagtgctgtcaatgccgcaggggaaggaccgcctggagaaacacaacctgttactgtggctgaaccacaagagcctccagctgtggaactggatgtttctgtcaagggtggaatacaaataatggctgggaagactcttagaattccagctgtggtgactggtcgccctgtacctacaaaagtatggaccaaagaagaaggggagctggataaagaccgtgttgtaatagacaacgttggaaccaaatctgaactaattatcaaggatgcactgcgaaaagaccatggcagatatgtgattacagctacaaatagctgtggttccaaatttgcagcagccagggtagaagtttttgatgtccctggtccagttcttgacttaaaacctgttgtaacaaacagaaaaatgtgtctacttaactggtctgatccagaagatgatggaggaagtgaaataacaggctttatcattgaaagaaaagatgccaagatgcatacttggagacaaccaatagagactgagagatctaaatgtgacatcacaggtctgcttgagggacaagaatataagttccgtgttattgccaagaacaagtttggctgtggccctcctgttgaaataggaccaattcttgcagttgatccactaggtcctccaacatctccagagaggctcacatacactgaaaggacaaagtccactatcacacttgactggaaagagccccgcagtaatggtggcagtcccatccaaggatatatcattgaaaaacggcgtcatgacaaacctgactttgaaagagttaacaagcgactctgcccaaccacatcttttctggttgaaaatcttgatgaacaccaaatgtatgagttccgtgtcaaagctgtcaatgaaattggtgaaagtgaaccatccctacctcttaatgtagtcatacaagatgatgaagtgcctccaactattaagttgcgtctgagtgttcgaggagacactatcaaagttaaggcaggagagcctgtccacatccctgcagatgtgacaggccttccaatgcctaagattgaatggtccaaaaatgaaactgtaattgaaaaacccactgatgcacttcagataaccaaggaagaggtatcccgaagtgaggcaaaaactgagcttagcattcccaaagcggtccgggaggacaaaggcacttacacagttactgcttccaatcgccttggctcagtgttccgaaatgttcacgttgaagtatatgaccgcccatccccaccaagaaatcttgctgttactgacattaaagctgaatcttgctacttgacatgggatgcccctcttgataatggtggcagtgaaatcacccattatgttattgacaaacgtgatgcaagtaggaagaaagcagaatgggaggaagtcaccaacactgctgtagagaaaagatatgggatctggaaacttatccccaatggtcagtatgagttccgagtcagggcagtgaataaatatggaatcagtgatgagtgcaaatcagataaagtagtcattcaagatccttatcgccttcctggacctccaggaaaaccaaaagttttggcacgcaccaaaggatcaatgctagtgagctggactcctcctttggacaatggtggctctccaattactggctactggctggagaaaagagaagagggaagtccttattggtcacgtgttagccgagcaccaataaccaaagtgggattgaaaggcgtggaatttaatgttcctcgtttgcttgaaggcgttaaataccagttcagagccatggcaataaatgctgcaggaattggtcctcccagtgaaccatcagatccagaggttgcaggagatcccatatttccaccggggccaccttcttgcccagaagttaaagataaaacgaagtcaagcatctcactaggatggaaacctccagccaaagatggtggcagcccaatcaaaggatacattgtagaaatgcaagaagaaggtactactgactggaaaagagtaaatgaaccagacaaacttataactacctgtgaatgtgtggtgcctaatctgaaagagctcaggaagtacagattcagagtgaaagctgtcaatgaagctggtgaatctgaaccaagtgatacaactggggagatccctgccactgatattcaagaggaaccagaagttttcattgacattggagcacaggactgtctggtttgtaaagctggctcacagattaggattcctgctgtcatcaagggacgcccaacaccaaaatcatcttgggaatttgatggaaaggcaaagaaagcaatgaaggatggagttcatgacatacccgaagatgcacagctggagactgctgaaaactcctcagtaattattattccggagtgtaaacgatctcatacaggcaaatacagcatcacagccaagaataaagcaggacaaaagactgcaaattgcagagttaaagtcatggatgtaccaggcccacccaaagatctgaaagtcagtgatatcacaaggggtagttgcagactttcatggaagatgccagacgacgatggaggagacaggatcaaaggctatgttattgagaagaggactattgatggaaaagcctggaccaaagtcaatccagactgtggaagcaccacatttgtagtgcctgatctcctctctgaacagcaatatttcttccgtgtgcgagcagaaaaccgttttggtattggcccacctgtggaaaccattcagaggaccactgccagagatccgatatatcctcctgatcctcctattaaactcaagattggcctcatcacaaagaacacagtgcatctgtcatggaaacccccgaagaatgatgggggctcccctgttacccactatattgttgagtgccttgcatgggaccctactgggacaaagaaagaagcctggaggcagtgcaataagcgtgatgtggaagaactgcaatttactgttgaagacctagtagagggtggggaatatgaattccgagtcaaagctgtcaatgctgcaggagtcagcaagccttcagccactgttggccctgtgactgtcaaagaccagacatgcccaccatcaattgatctaaaagaattcatggaggttgaagaaggaaccaatgttaacattgtggccaaaattaaaggtgtgccattcccgacactaacctggtttaaagctcctccaaagaagcctgataacaaagaacctgttctctatgacacccatgtcaacaaactggtggtagatgatacttgcactttagttattccgcagtctcgcaggagtgacactggcttatataccatcacagctgtaaataatctgggaacagcatcaaaggagatgagactgaatgtcctgggtcgtcctggccctccagtgggacccataaaatttgaatctgtttcagcagatcaaatgacactatcttggtttccacctaaagatgatggtgggtctaagattacaaactatgtaattgagaaaagagaagctaacaggaagacatgggtccatgtctccagtgaacctaaggagtgcacgtacacgattcccaaattgctagaaggccatgaatatgtattccgaatcatggcccagaataaatatggcattggagaacctcttgacagtgaacctgaaacagcaagaaacctcttctctgtccctggagcaccagataaaccaacagttagcagcgtgactcgtaactccatgactgtcaactgggaagagccagaatatgatggaggctctcctgtgacagggtactggctggaaatgaaagacaccacttcaaagagatggaagagagttaaccgagatcctatcaaagccatgactttgggtgtttcttataaagtgactggtcttattgaaggttccgactatcaattccgggtatatgcaatcaatgctgctggcgtgggtccagcaagtctgccatcagacccagcgactgctagagatccaattgcccctcctggtcctccatttcccaaagtgacagattggactaaatcatctgcagatctggagtggtctcccccactaaaagatggtggatccaaagtaactggatacatcgttgaatataaagaagaaggaaaagaagaatgggaaaagggtaaagataaagaagtgagaggaacaaagcttgttgtgacaggattaaaggaaggagcattctacaaatttagagttagagcagtcaacattgctggcattggagaacctggagaggtcacagatgtcattgaaatgaaggacagacttgtttcacctgaccttcagctagatgccagtgtcagagatagaattgttgtccatgctggaggggtgatccgaatcattgcctatgtgtctggaaagcctcctccaaccgtcacctggaacatgaatgaaagaaccttacctcaagaagccaccattgagaccacagccattagctcatccatggtcatcaagaactgccagaggagccatcaaggcgtctattctcttcttgccaaaaatgaagccggagaaagaaagaagacaattattgttgatgtattagatgttccaggtcccgttggaacaccattcctagctcacaacctaaccaatgagtcctgcaaactgacatggttttctccagaagatgatggaggctctccaatcaccaattatgtcattgaaaagcgtgaatctgaccgcagagcatggaccccagtgacatatacagttacccgacaaaatgctactgtccagggtctcattcaaggaaaagcctactttttccgaattgcggctgaaaatagtattggcatgggtccatttgttgagacatcagaggcacttgttatcagagagccaataactgtaccagagcgtcctgaagacctggaagtcaaagaagttactaaaaatactgtaactttgacttggaatcctcctaagtatgatggtgggtcagaaattattaactatgtcctagaaagtcggctcattgggactgagaagttccacaaagttacaaatgacaacttgcttagcagaaaatacactgttaaaggcttaaaagaaggtgatacctatgagtaccgtgtcagtgctgtcaacattgttggacaaggcaaaccatcattttgcaccaaaccaattacttgcaaggatgagctggcacccccaacgcttcacctcgacttcagagataagctcacgattcgagttggtgaagcttttgccctcactggccgttactcaggcaaaccaaagcctaaggtttcctggttcaaagatgaagctgatgtgctggaagatgatcgcactcatataaagactacaccagcaacacttgctttagagaagatcaaggccaaacgttcagattccggcaaatactgtgtggttgtggagaacagtacaggctctaggaaaggtttctgtcaagttaatgttgttgaccgtcctggaccaccagtaggaccagttagttttgatgaggtgaccaaagattacatggttatctcttggaagcctcctttagatgatggaggcagtaaaatcaccaattatattattgagaagaaggaagtgggtaaagacgtctggatgccagtgacatctgcaagtgctaaaacaacatgcaaagtttctaaactacttgaaggaaaagattatattttccggatacatgctgaaaatctgtatggaataagtgatcctctggtgtctgattcaatgaaagccaaagatcgtttcagggttcctgatgcacctgatcagccaattgttacagaagttaccaaagactctgcattagtaacctggaataagccacatgatggaggaaaacccatcacaaactacatcctggaaaagagagaaactatgtctaaacgatgggctagagttaccaaagatcctattcatccatacactaaatttagggttcctgatcttctagaaggatgtcagtatgaattccgggtttctgcagaaaatgaaattggtattggagatccaagcccaccatccaaaccagtctttgctaaagatccaattgctaaaccaagtccacctgttaatcctgaagcaatagatacaacatgcaattcagtcgatctaacttggcagccaccacgtcatgatggtgggagcaagattctgggttatattgttgagtaccagaaagttggagatgaagagtggagaagagccaatcacacccctgagtcatgtcctgaaactaaatataaagtcaccggtcttcgggacggtcaaacctataagtttagagtgttagcagtcaatgcagctggtgaatcagatccagctcatgttccggagccagtcctagtaaaagacaggcttgaaccccctgagttgattcttgatgccaacatggcaagagaacaacacattaaagttggtgatactctaagacttagtgccatcatcaaaggagtgccattcccaaaagtaacttggaaaaaagaagacagagatgctccaactaaagcaagaattgatgtgactccagttggtagcaagcttgaaattcgtaatgctgcccatgaagatggtggaatttattctttaacagtggagaatccagctggttcaaaaactgtctcagtaaaagtacttgtattagataaacctgggccacctagagatctggaagtcagtgaaattaggaaagattcatgttaccttacttggaaagaaccactggatgatggtggttctgttattaccaattatgtggttgagaggagagatgttgccagcgcccagtggtcacctctctcagctacatcaaagaaaaagagtcacttcgctaagcatctgaatgaaggcaaccagtacctcttccgagtagctgcggagaaccagtatggacgtggtccttttgttgaaacaccaaaaccaatcaaggctttggatcctctccatcccccagggccacccaaggacctgcaccatgtagatgttgacaagactgaagtctccctagtctggaataagccggatcgtgatggtggttctccaatcactggatatttggtagaatatcaagaagaaggcacccaggactggattaaatttaagactgtgacaaacttagagtgtgtggttactggactacaacaaggaaagacctatagattccgtgtaaaagctgaaaacattgtgggtcttggtctccctgacacaactatcccgatagaatgtcaagaaaaactagtgcctccatccgtggagctagatgtgaaattaattgaaggtcttgtggtaaaggctggaaccacagtcagattccctgctattataagaggtgtgcctgttcctactgcaaagtggacaaccgatgggagtgagattaaaaccgatgagcactacacagttgaaacagacaacttctcatcagtacttaccattaagaactgcttaaggagagacactggggaatatcaaatcacagtttccaatgcagccggtagcaaaacagtagccgtacatcttactgttcttgatgttcctgggccaccaacaggtcctattaatattctggatgttactcctgaacacatgactatctcatggcagccacctaaggatgatggaggaagccctgtgataaattatattgttgagaaacaagatacaaggaaagacacgtggggtgttgtctcttccggaagcagtaagacaaagctgaaaatcccacatctgcagaagggctgtgaatatgttttccgagttagagcagagaataagataggtgttggtcctccccttgactccacacctactgttgctaagcataaatttagtcctccgtctcctcctggtaaaccagtggttactgacattactgaaaatgcagcaacagtgtcttggaccctgccaaaatctgatggtggcagtccaataactggctactatatggaacgtcgagaagtaactggcaaatgggtgagggtcaacaaaacacctatcgctgacctgaagttcagagtgactggactctatgaaggaaatacatatgagtttagagtttttgctgaaaatcttgcaggactaagcaaaccatccccaagttctgatccaataaaagcttgccggcccatcaaaccacctggaccacctattaatcctaaactgaaagacaagagcagagaaacagctgatttggtgtggacaaagcctctcagtgatggtggtagccccattctaggatatgtagtggaatgtcagaaacctggcacggcacaatggaacaggattaataaagatgaactcattaggcaatgtgcctttagggtacctggactaattgaaggaaatgagtacagattccgtataaaggcagctaatattgtaggagagggtgagccaagagaactagcagaatctgtgattgcaaaagatatccttcatcctccagaagtagaacttgatgttacttgtcgtgatgttattaccgtgagagtaggccaaactatccgcattctagctcgagtcaaaggcagacctgaaccagacataacttggactaaggaaggcaaagtattggtccgagaaaagagggtggaccttattcaggatctacctcgtgttgagttacaaattaaagaagctgttagagctgatcatggcaagtatatcatctcagctaagaacagcagtggacatgcccaaggttcagccatcgttaacgtccttgacagacctgggccttgccagaatttgaaggttaccaatgtaaccaaagagaactgtacaatttcttgggaaaacccactagataatggtggctcagaaataacaaacttcatagtagaatatcgcaaaccaaaccagaaaggctggtcaattgttgcatcagatgtcactaaacgattaatcaaggccaaccttttagccaacaatgaatactatttccgagtttgtgcagagaataaagtaggtgttgggccaaccatcgaaacaaaaactcccattctggctattaaccctattgacagaccaggtgagcctgaaaaccttcacattgcagataaaggaaagacatttgtctatctaaagtggcggaggcctgactatgatggtggcagtccaaatctgtcatatcatgttgagagaaggcttaagggctccgatgactgggaaagagtgcataaaggaagcattaaagaaactcactacatggttgacagatgtgttgaaaaccagatttatgagttcagagtgcaaacaaagaatgaaggtggggaaagtgactgggtgaagacagaggaagttgttgtgaaagaagacttacaaaaaccagtacttgatctgaaattaagtggggtcctaactgtcaaagcaggggacaccattaggcttgaggcaggggttagaggcaaaccattcccagaagttgcatggaccaaggacaaagacgctacagacttaacaagatcaccaagggtcaagattgatacccgtgctgattcatctaaattttctcttactaaagcaaagcgaagtgatgggggtaaatatgtagttacggcaactaacacggctggcagttttgtggcctatgccactgtcaatgttttagataagcctggtcctgtgagaaatctgaaaattgttgatgtgtccagtgataggtgtactgtttgctgggatccaccagaagatgatggtggctgtgaaatccaaaattatattctagaaaaatgtgagacaaagcgaatggtttggtctacctattctgctactgtcttgacacctggtactacagtaacacgtctcatagaaggaaatgaatatattttcagagtccgtgcagaaaataaaataggcacagggcctccaacagaaagtaaaccagtcatagccaaaaccaagtatgataaacctggtcgccctgatcccccagaagtcactaaagtaagcaaagaagagatgactgtggtttggaatccacctgaatatgatggtggaaagtctataactggatactttttggagaaaaaggaaaagcattcaacacgatgggtccctgtcaacaagagtgcaatccctgagagacgtatgaaagtacagaatctcctcccagaccatgaatatcagttccgtgtcaaggcagaaaatgaaattggaattggagaaccaagcttgccttcaagaccggtggtggcaaaagaccccatagagccacctggtccaccaaccaatttcagagtggttgatacaaccaaacattccataactcttgggtggggaaaaccagtctatgatggtggtgcaccgatcattggatatgttgtggaaatgagaccaaaaatagcagatgcgtctcctgatgaaggctggaaacggtgtaatgctgcagcacagcttgtacgcaaggaattcactgttaccagcttggatgaaaaccaggaatatgagttcagggtgtgtgcccaaaaccaagttggtattgggcgccctgcagagctaaaggaagctatcaaacctaaagaaatactagaacctccggagattgatttggatgccagcatgaggaaactggtcatagtgagagcaggatgccctattcgtctctttgctatagtgagaggacgaccagcccctaaagtcacttggcgaaaagttggcattgataatgtggtcagaaaaggacaagttgatctggttgacactatggccttccttgtcatccccaattctacccgtgatgactcaggaaaatattccttaacacttgtgaacccagcaggagaaaaggctgtattcgtaaatgtcagagtattagacactcctgggcctgtgtctgatttaaaagtttcagatgtcactaaaacatcatgccatgtgtcctgggcccctcctgaaaacgacggtgggagccaagtgacacattatatcgtggagaaacgtgaggcagacagaaagacatggtcgaccgttaccccagaagttaagaaaacaagcttccatgtaaccaatcttgtccctgggaatgagtattacttcagagtaactgctgtcaacgaatatggccctggcgtcccaacagatgtcccaaaaccagtgcttgcatcagatcctctaagtgagccggatcccccaaggaaattagaagtgactgaaatgaccaagaacagtgccaccttagcctggttacctcccctacgtgatggaggtgctaaaatcgatggctacatcactagttacagagaagaagagcagcctgcagatcgctggacagagtactcagtggtaaaagatctgagccttgttgtcactggcctaaaggaaggaaagaaatacaaatttagagtagcggccagaaatgctgttggagtcagtttgccaagagaagctgaaggagtgtatgaagccaaagaacaactgttgccaccaaagatccttatgccagagcaaataactatcaaagctgggaaaaaactccgaattgaagcccatgtgtatggaaagcctcatcccacctgtaaatggaaaaaaggagaagatgaagttgtcacatccagccacctggcagtgcataaagcagacagctcttcaattctgatcataaaagatgtgactaggaaagacagtggttactacagcctcacagcagagaacagttctgggacagacactcagaaaatcaaagttgtagtcatggatgcccccggcccccctcagcctccatttgacatttctgatatagacgctgatgcttgctccctgtcatggcacatccctctggaggacggaggcagtaacatcaccaattatatagtggagaagtgtgatgtaagccgaggtgactgggtcacggctctagcttcagtcacaaaaacttcctgcagggttggaaagctgatcccaggccaggagtacatcttccgggtccgtgctgaaaaccgatttggcatttcagagcctctcacatctccaaagatggttgcgcagttcccatttggtgttcctagtgaaccaaagaatgcacgagtcaccaaagtcaacaaggactgtatttttgttgcttgggacagaccagatagtgatggagggagccccattattggttatctgattgaacgcaaggaaagaaacagtttgctgtgggtgaaagccaatgatactcttgtccggtcaactgaatatccttgtgctggccttgtagaaggtcttgagtattcattcagaatctatgccctaaacaaagctggatccagcccacccagcaaacccacagaatatgtaactgcaagaatgccagttgatcctcctgggaaacctgaggttattgatgtcaccaagagtactgtatctctgatctgggctcgtccaaagcatgatggaggcagtaaaattattggctatttcgtagaagcttgcaaacttcctggtgataaatgggtacggtgcaatactgcacctcaccagattccccaggaagagtacacagctactggcctagaagagaaagctcagtatcaatttagagctattgccaggaccgcggtaaacattagcccaccttctgaaccttctgatccagtgactatcctcgcagaaaatgtccctcccaggatagacctgagtgtggctatgaaatctttgcttactgtgaaagctggaactaatgtctgcttggatgctactgtttttggtaaaccgatgccaacagtttcttggaaaaaagatggcacactgctaaaaccagcagaaggcataaagatggccatgcagcggaatctgtgcaccttggagctattcagcgtgaaccggaaggactcaggagactataccattactgctgaaaattcaagtggttctaaatcagccaccattaagcttaaagtgttagataaaccgggtcctccagcatctgttaaaatcaacaaaatgtattcagatcgtgctatgctttcttgggaaccgcctcttgaagatggaggctcagaaatcaccaactatattgttgacaaacgtgaaacaagcaggcccaactgggctcaagtctctgcaactgtgcctatcaccagctgcagcgtggagaaacttatagagggccatgagtatcagttccgtatttgtgctgaaaataaatatggagtaggcgatccagtcttcactgaaccagcaattgccaaaaacccatatgacccaccaggacgctgtgatcctcctgttattagcaacataaccaaagatcacatgacagtcagctggaagccaccagcagatgatgggggctcacccatcactggctatttgcttgaaaagcgggaaacccaggctgttaactggactaaggtcaacagaaaacctattatagaaagaacattaaaagcaacaggtcttcaagaaggtaccgaatatgagttccgtgttacagctataaataaagctggaccaggcaaacccagtgacgcatccaaggccgcttatgctcgggaccctcagtatcctcctggcccaccggctttccctaaagtatatgatacaactcgcagctctgtgagtctatcttggggcaagccagcctatgacggcggcagccctatcattggttatctcgttgaagtaaaacgggctgactccgataactgggtgaggtgcaacttaccacagaatctacagaaaacccgctttgaggttactggcctgatggaagacacacaatatcaattccgtgtgtatgccgttaataagattggatacagtgaccccagtgatgtgccagataaacactatcccaaggacatcttaattccacctgagggagaacttgatgcggacttaaggaagacactcatattacgtgctggagttactatgagactatatgtaccagtaaaaggacgcccacctccaaagattacttggtctaaaccaaatgtcaatctaagagacaggattggactggacataaagtcaactgactttgacactttcttgcgctgtgaaaatgtgaacaaatatgatgcaggaaaatatatcttaaccctggagaacagctgtggtaaaaaggaatataccattgttgtgaaagtgcttgatactcctgggccacctgtcaatgtgactgttaaggaaatatccaaagactctgcttatgttacctgggagcctcccattattgatggcggaagccccatcataaactatgtggtacaaaaacgtgatgcagagaggaaatcctggtctacagtgacaactgagtgctccaaaacaagcttcagagtacctaatttggaggagggaaaatcctacttcttccgagtgtttgctgaaaatgagtatggcattggtgatcccggtgaaactcgtgatgctgtcaaagcttcccaaactcctggaccagttgtggacctgaaagtgaggtctgtatctaagtcatcctgtagcattggctggaaaaagcctcacagtgatggtggaagtcggattattggatatgtagttgatttcctgactgaagaaaataagtggcaacgagttatgaaatccttaagcctacagtactctgcaaaagatttgactgaagggaaggaatataccttcagagtgagtgctgagaatgaaaatggagaaggaaccccaagcgaaatcactgttgtggcaagggatgatgttgtggctcctgatcttgacttaaagggtctacctgatttgtgctacttggctaaagaaaacagcaacttccggcttaagatccccataaaaggcaagccagctccatcagtctcctggaagaaaggggaagatcctctagcaactgacactagagtcagtgttgagtcatctgcggttaacacaactcttatagtgtacgattgccaaaaatctgatgctggaaaatacacaatcacacttaagaatgttgctggcaccaaggaaggaactatctccataaaggttgttggcaagcctggcatccccactggaccaatcaaatttgatgaagtcacagcagaagccatgaccttaaagtgggctcctccaaaggatgatggaggttctgaaatcaccaactatatcctagagaagagggattctgtgaacaacaagtgggtgacgtgcgcctcagctgtccagaaaaccacctttagagtaaccagacttcatgagggcatggaatataccttcagggtcagtgccgaaaataaatatggtgtaggggaaggcctgaaatcggagccaattgttgcgagacatccatttgatgtgcctgatgctcccccacctcccaatattgtggatgtcagacacgattcagtatctctaacttggactgaccccaagaaaactggtggttctccaattacagggtatcatctcgagttcaaggaaagaaacagccttttgtggaagagagctaacaagactccgataaggatgagagactttaaagtgacaggattaactgaaggtcttgaatatgaattccgagttatggcaatcaatttagcaggtgtgggcaagccaagcctaccatcagagcctgttgtggcactggacccaattgatcctcctggaaaacctgaggttattaacataacaaggaattcagtgactctcatttggactgaacctaaatatgacggtggtcataagttaactggatatatagtggagaagcgagatctaccttcgaagtcttggatgaaagccaaccatgttaatgtcccagaatgtgcctttactgtaactgaccttgttgagggtggaaaatatgaattcagaattagagcaaagaatacagcaggtgctatcagtgctccatcagaaagtacagaaaccattatttgcaaggatgaatacgaggcaccaacaattgtccttgatcccacaataaaagatgggctaacaattaaagcaggggataccattgttttgaatgccattagcattcttggcaaaccccttccaaaatcaagttggtccaaggcaggaaaagacattagaccatcagatatcactcagataacttcaaccccaacatcttccatgcttactatcaagtatgccactagaaaagatgcgggtgaatataccatcactgctaccaatccttttggcacgaaggtggaacatgtgaaggtaacagtccttgatgtacctggtcccccaggtcctgttgaaatcagtaatgtttctgctgaaaaagcaacacttacatggacacctcccttggaagatggcggctcaccaattaagtcctatatacttgaaaagagagaaaccagccgacttttgtggacagtggtttctgaagatattcagtcttgcaggcatgtggcaaccaaacttatccaaggaaatgagtacatcttccgggtctcagctgtaaaccactatggcaaaggagaacctgtacagtctgaacctgtcaaaatggtagacagatttggtccccctggccctcctgaaaaaccagaggtatcaaatgtcactaagaacactgccactgtcagctggaaaaggccagtggatgatggtggcagcgaaattacaggatatcatgtagaaaggagagaaaagaaaagcctgcgatgggtgagagcaataaaaacaccagtttccgatctcaggtgcaaagtaacaggactgcaagaaggaagcacctacgaattccgtgtcagtgcagaaaacagagcaggaattggtccacccagtgaggcttcagattctgttctgatgaaagatgcagcatatcctccaggaccaccttcaaatccgcatgtcactgatactaccaagaaatctgcttctttggcatggggcaagcctcattatgatggtggacttgaaatcactggctatgtcgtggagcatcaaaaagtaggagacgaggcctggataaaagataccacaggaaccgccctcagaatcactcagttcgttgttcctgatcttcagactaaagaaaaatacaacttcagaatcagtgccatcaacgatgcaggtgttggggagccagcggtgattccagatgttgaaatcgtagaacgggagatggctcctgattttgaactagatgccgagcttcgaagaacacttgttgttagagcaggactcagtattaggatatttgtgccaattaaaggtcgtcctgctcctgaagtgacatggaccaaagataacatcaacctgaaaaaccgagccaacattgaaaatacggaatcatttactcttctgattatcccagaatgtaacagatatgataccggtaaatttgtcatgaccattgaaaacccggctgggaagaaaagtggctttgtgaacgtcagagtcttggacacgccaggcccagtcctcaacctgcggcctacagacatcacaaaggacagtgtcaccctgcactgggacctccctctgatagatggaggctcacgtataacaaactacattgtagagaaacgtgaagcaacacggaaatcttattccacagccaccactaagtgccataaatgcacatataaagttaccggcttgtctgaagggtgtgaatatttcttcagagtgatggcagagaatgaatatggaattggtgagccaacagaaactacagagcccgtaaaagcctctgaagcaccatctccaccagacagccttaacatcatggacataactaagagcaccgtcagcctggcatggcctaagcccaaacacgatggtggcagcaagatcactggctatgtgattgaagcccaaagaaaaggctctgaccagtggacccacatcacaaccgtgaaagggttagaatgtgttgtgaggaatctaactgaaggagaggaatataccttccaagtgatggcagtgaacagcgcggggagaagtgcccctagagaaagcagacccgtcattgtcaaggagcagacaatgcttccagagctggatctccgtggcatctatcagaaactggtcattgccaaagctggtgacaacatcaaagttgaaattccagtgctcggtcgaccgaagcccacagtgacatggaaaaaaggagaccaaattcttaaacagacacagagagttaattttgaaaccacagcgacttcaaccattttaaatatcaatgagtgtgtcagaagtgatagtgggccctatccattaacagcaaggaacattgtaggagaggttggtgatgtcatcaccattcaagtccatgatatcccagggccacctactggaccaatcaaatttgatgaagtttcatctgattttgtaaccttctcttgggacccacctgagaacgatggtggtgtaccaataagcaactatgtagtggaaatgcggcagactgacagtactacctgggttgagttagcaaccaccgttatacgtactacctataaagccacccgccttactactggattagagtatcagttccgtgtaaaagctcagaatagatatggagttggaccaggcatcacatcagcatgcatagttgccaactatccatttaaggttcctggacctcctggtacccctcaggtaactgcagttaccaaggattcaatgacaattagctggcatgagccactttctgatggtggaagccccattttaggatatcatgttgaaagaaaagaacgaaatggtattctctggcagactgtgagcaaagctttagtaccaggcaacattttcaaatcaagtggacttacagatggtattgcttatgagttccgggtgattgcagaaaacatggcaggcaaaagtaagccaagcaagccatcagaacctatgttggctctggatcccattgacccacctggaaaaccagtacctctaaatattacaagacacacagtaacacttaaatgggctaagcctgaatatactgggggctttaaaattaccagttatatcgttgaaaagagagaccttcctaatggacggtggctgaaggccaacttcagcaacattttggagaatgaatttacagtcagtggcctaacagaagatgctgcatatgaattccgtgtgatcgccaaaaatgctgcaggtgccatcagtccaccatctgagccatctgatgctatcacttgcagggatgatgttgaggcaccaaagataaaggtggatgttaaatttaaggacacggttatattaaaagcaggtgaagcattcagactggaagctgatgtttcaggccgcccacctccaacaatggaatggagcaaagatggaaaagagctggaaggcacagcaaagttagaaataaaaattgcagatttctctactaatctggtaaacaaagattcaacaagaagggatagtggtgcctatacccttacagcgactaatcctggtggctttgctaaacacattttcaatgtcaaagttcttgacagaccaggcccacctgaaggacctttggctgtaactgaagtgacatcagaaaagtgtgtactatcatggttccctccactggatgatggaggtgccaaaattgatcattacatagtacagaaacgtgaaaccagcagattggcatggacaaatgtagcctcagaagtccaagtaacaaagctaaaggtcactaaactcttgaaaggcaatgaatacatattccgtgtcatggctgtaaataaatatggagtgggagagccactggaatcagagcctgtgcttgcagtgaatccttatggaccccctgatccgcccaaaaaccctgaagtgacaactattactaaagattcgatggttgtctgctggggacatcctgattctgatggtggaagtgaaatcatcaattatattgtggaacggcgtgataaagctggccaacgctggattaaatgcaacaaaaaaactcttactgatttaagatataaagtgtctggactgacagaaggacatgaatatgagttcaggattatggctgaaaatgctgctggaattagtgcaccaagtcctaccagtccattttacaaggcttgtgacactgtgtttaaacctggaccaccaggtaacccacgtgttctggatacaagcagatcatccatttcaatcgcttggaataaacctatctatgatggtggttcagaaatcactgggtatatggttgagattgccctgccagaggaagatgaatggcagattgtcactccaccagcaggactcaaggcaacttcgtatactatcactggcctcacagagaatcaggaatataagatccgcatctatgccatgaattccgaaggacttggggaacctgcccttgttcctggaactccaaaggctgaagacagaatgctgcctccagaaattgaactggatgctgacctgcgcaaagttgttactataagggcctgctgcaccctgagactttttgttcccatcaaaggaaggcctgcacctgaggtgaagtgggcccgggaccatggagaatctttagataaagctagcatcgaatccacaagctcttacaccctgcttattgttggaaatgtaaacagatttgacagtggcaaatatatactaactgtagaaaatagttcaggcagcaagtctgcatttgtcaatgttagagttctcgatacaccaggccccccacaggatctgaaggtaaaagaggtcactaagacatctgtcacactcacatgggacccacctctccttgatggaggttcaaaaatcaagaactatattgttgaaaagcgggaatcaacaagaaaagcatattcaactgttgcaacaaactgccacaagacttcctggaaggtagaccagcttcaagaaggctgtagctactatttcagggttctcgcagaaaatgaatatggcattgggctgcctgctgaaaccgcagaatctgtgaaagcatcagaacgacctcttcctccaggaaaaataactttgatggatgtcacaagaaatagtgtgtcactctcttgggagaaaccagagcatgatggaggcagccgaattctaggctacattgtggagatgcagaccaaaggcagtgacaaatgggccacgtgtgccacagtcaaggtcactgaagccactatcactggattaattcagggtgaagaatactctttccgtgtttcagctcagaatgaaaagggcatcagtgatcctagacaactgagtgtgccagtgatcgccaaagatcttgtcattccaccagccttcaaactcctgttcaatactttcactgtactggcaggtgaagacctaaaagttgatgttccattcattggccgccctaccccagctgtaacctggcataaagataatgtaccactgaagcagacaactagagtaaatgcagagagcacagaaaataattcactactgacaataaaggacgcctgccgagaagatgttggccattatgtggttaaactgactaactcagctggtgaagctattgaaacccttaatgttatcgttcttgacaaaccagggcctccaactggaccagttaaaatggatgaagtgacagctgatagtattactctttcctggggcccacccaagtatgatggtggaagttctatcaataattacattgttgagaaacgggacacttccacaaccacctggcaaattgtatcagctacagttgcaaggacaacaataaaggcttgcagactgaagactggatgtgaatatcagtttagaattgcagctgaaaacagatatgggaagagtacctacctcaattcagagcctactgtagcccaatatccattcaaagttcctggtcctcctggcactccagttgtcacactgtcctccagggacagcatggaagtacaatggaatgagccaatcagtgatggaggaagtagagtcattggctatcatctagaacgcaaggaaagaaatagcatcctctgggttaagttgaataaaacacctattcctcaaaccaagtttaagacaactggccttgaagaaggtgttgaatatgaatttagagtctctgcagagaacatcgtgggcattggcaagccgagtaaagtatcagaatgttatgtggctcgtgacccatgtgatccaccaggacggccagaggcaatcattgtcacaaggaattctgtgactcttcagtggaagaaacccacctatgacggtggaagcaagatcactggttatattgttgagaagaaagaattacctgagggccgttggatgaaagccagttttacaaatattattgacactcattttgaagtaactggcctagttgaagatcacagatatgagttccgggttatagcccgaaatgccgcaggagtgtttagtgagccttcagaaagcacaggagcaataacagctagagatgaggtagatccaccacgaataagtatggatccaaaatacaaagacacaatcgtggttcatgctggtgaatcattcaaggttgatgcagatatttatggcaaaccaataccaaccattcagtggataaaaggtgatcaggagctttcaaacacagctcgattagaaataaagagcaccgactttgccaccagtctcagtgtaaaagatgcagtacgtgtcgacagtggaaattacatactgaaggccaaaaatgttgcaggagaaagatcagttactgtgaatgtcaaggttcttgacagaccagggccacctgaaggacctgttgttatctcaggagttacagcagaaaaatgcacactagcttggaaacccccacttcaggatggtgggagtgacatcataaattatattgtggaaaggagagaaaccagccgcttagtttggactgtggttgatgccaatgtgcagactctcagctgcaaggttactaagcttcttgaaggcaatgaatatactttccgtataatggcagtaaacaaatatggtgttggtgaacctcttgaatctgagccagtagttgccaagaatccatttgtagtaccagatgcaccaaaagctccagaagtcacaacagtgaccaaggactcaatgattgttgtatgggaaagaccagcatctgatggtggtagtgaaattcttggatatgttcttgagaaacgggataaagaaggcattagatggacaagatgccataagcgtctgattggagagttgcgcctgagagtaactggactcatagaaaatcacgattatgagttcagagtttctgctgagaatgctgctggacttagtgaaccaagccctccttctgcttaccaaaaggcttgtgatcctatttataaaccaggacccccaaacaaccccaaagtcatagacataaccagatcttcagtattcctttcttggagcaaaccaatatatgatggtggctgtgaaattcaaggatacattgttgaaaaatgtgatgtgagtgttggtgaatggacaatgtgcactccaccaacaggaattaataaaacaaacatagaagtagagaagctgttggaaaagcatgaatacaacttccgtatctgtgctattaataaagctggagttggagaacatgctgacgtccctggacctattatagttgaagaaaaattagaagcaccagacattgatcttgacctagaactaaggaaaatcataaatataagggcaggtggctccttaaggttatttgttcctataaaaggtcgtcctacaccagaagttaaatggggaaaggtggatggtgaaatccgagatgcagctataattgatgtcactagcagtttcacctctcttgttcttgacaatgtcaaccgatatgatagtggaaaatatacgcttacattagaaaacagcagtggaacaaagtctgcctttgttactgtgagagttctggacacgccaagtccacctgttaacctgaaagtcacagaaatcaccaaagactcagtatcaattacatgggaacctcctttgttggatgggggatccaaaataaaaaattacattgttgagaaacgtgaagccacaagaaaatcatatgctgctgttgtaactaactgccataagaattcttggaaaatcgatcagctccaagaaggttgcagttattactttagagtcacagctgagaatgagtatggtattggccttcctgcccagactgctgatccaattaaggttgcagaagtgccacaacctcctggaaaaataactgtggatgatgtcaccagaaacagtgtctctctgagttggacaaaacctgaacatgatggtggcagtaaaatcattcagtatattgtggaaatgcaagctaaacacagtgagaaatggtcagagtgtgctcgagtaaagtctcttcaggcagtaattaccaacctaactcaaggggaagaatatctttttagagttgttgctgtaaatgaaaaggggagaagtgatcctcggtcccttgcagttccaatagttgccaaagatctggtaattgagccagatgtaaaacctgcattcagtagttacagtgtacaggttggccaagatttgaaaatagaagtgccaatttctggacgtcctaagccaaccattacctggactaaagatggtctcccactgaagcagaccacaagaatcaatgttaccgattcactggatctcaccacactcagtattaaagaaactcataaggatgatggtggacaatatggaatcacagttgccaatgttgttggtcagaagacagcatccatcgaaattgtaactctagataaacctgatcctccaaaaggacctgttaaatttgatgacgtcagtgctgaaagtattacattatcttggaaccctccattatatacagggggctgccaaatcaccaactacattgttcagaaaagagatacaaccaccacagtatgggatgttgtttctgctactgttgctagaactacactcaaagtgaccaaactgaaaactggtacagaataccaatttagaatatttgccgaaaacagatatggacaaagctttgccttagagtctgatccaattgtagctcaatatccctacaaagaaccaggccctccaggtacaccatttgccacagccatttccaaagactccatggtcatacagtggcatgaaccagtcaacaatggtggaagccccgtcataggttaccacctggagagaaaagaaagaaacagtattttgtggacaaaggtcaacaaaactattattcatgacacccaattcaaagcacagaatcttgaagaaggcattgaatatgaattcagagtgtatgctgaaaatattgttggtgtaggcaaagcaagcaagaattctgaatgctatgtagccagagatccctgtgacccaccaggaaccccagaaccaataatggttaaaagaaatgaaatcactttacagtggaccaaacctgtgtatgatggtggaagtatgattacaggctacattgtagagaaacgtgatttgcctgatggtcgttggatgaaagctagctttacaaatgtcattgaaactcaatttactgtgtcaggtcttactgaagatcaaagatatgaattcagagtcattgcaaagaatgcagctggtgcaataagtaaaccctctgacagtactggaccaataactgccaaggatgaggttgaactcccaagaatttcaatggatccaaaattcagagacacaattgtggtaaatgctggagaaacattcagacttgaggctgatgtccatggaaagcccctacctaccattgagtggttaagaggagataaggaaattgaagaatctgctagatgtgaaataaagaacacagatttcaaggctttacttattgtaaaagatgcaattagaattgatggtgggcagtatattttaagagcttccaatgttgcaggttctaagtcattcccagtaaatgtaaaagtattagatagaccaggacctccagaagggccagtccaggttactggagtcacttctgaaaaatgctctttaacatggtctccaccacttcaagatggtggcagtgacatttctcactatgttgttgaaaagcgagaaaccagtcgacttgcctggactgttgttgcttcagaagttgtgaccaattctctgaaagttaccaaactcttagaaggtaatgaatatgttttccgtataatggctgtcaacaaatatggtgttggagagcctttggaatctgcaccagtactaatgaaaaatccatttgtgcttcctggaccaccaaaaagcttggaagtcacaaatattgccaaagactccatgaccgtctgttggaaccgtccagatagtgatggtggaagtgagattattggttacattgtagagaaaagagacagaagtggcattcgatggataaaatgtaataaacgccgcattacagatttgcgtctaagagtgacaggattaacagaagatcatgagtatgaattcagggtctctgcagaaaatgctgctggagttggggaaccaagtccagctacagtttattataaagcctgtgatcctgtgttcaaacctggcccacctaccaatgcacacattgtagacaccactaaaaattcaatcacacttgcctggggtaaacccatctatgatggcggcagtgagatcttgggatatgtagtagaaatctgtaaagcagatgaagaagaatggcaaatagttactccacagactggcctgagagtcactcgatttgaaatttcaaaactcactgaacaccaagagtataaaatacgagtctgtgccctcaacaaagttggtttaggtgaggctacatcagttcctggtactgtgaaaccagaagataaacttgaagcacctgaacttgaccttgactccgaattaagaaaaggaattgttgtaagagctggtggatctgccagaattcacattccattcaaaggtcgtccaacgcctgagatcacttggtctcgagaggaaggtgaattcacagataaggtccaaattgaaaagggagtaaactatacccaactatcaatagataactgtgatagaaatgatgctggaaaatacattcttaagttggaaaacagcagtggatcaaagtctgcttttgtaactgtgaaagttcttgacactccaggaccaccacagaatttggcagtcaaagaagtgagaaaagattctgccttcctggtatgggagccacccatcattgatggaggggcaaaggtcaagaactatgtgattgacaaacgtgagtcaaccagaaaagcgtatgctaatgtgagtagtaaatgcagcaaaacaagttttaaagtggaaaaccttacagaaggagccatttattacttcagagtcatggctgaaaatgaatttggagttggtgttccagtggaaactgttgatgccgtgaaagctgctgaacctccttccccaccaggaaaggttacactcactgatgtgtcccagaccagtgcatcacttatgtgggagaaacctgaacatgatggcggtagcagagtcctggggtacgttgttgaaatgcagcccaaaggaactgaaaaatggagcattgtggctgaatccaaagtctgtaatgcagttgttactggtttgagttctggacaagaatatcagttccgtgtcaaggcttataatgagaaaggaaaaagcgatccaagagtgttgggtgttcctgtcatagccaaggacttgactatacagcctagtttaaagttaccatttaacacatatagtatccaagctggagaagatcttaaaatagaaattccagttataggccgaccaagacctaacatttcttgggtcaaagatggtgagcctcttaaacagacaacaagagtaaacgttgaagaaacagctacctcaactgttttgcacattaaagaaggtaacaaagatgactttggaaaatacaccgtaacggcaacaaatagtgcaggcacagcaacagaaaatctcagtgttatcgttttagaaaagcctggacctccagttggcccagttcggtttgatgaagttagtgcagactttgtagtcatatcttgggaacctccagcctatactggtggctgccaaataagcaactacattgtagagaagcgagatacaaccaccaccacttggcacatggtatcagcaacagttgcaagaacaacaattaaaataaccaaactgaaaacaggcacggagtaccagtttagaatttttgctgaaaacaggtatggaaaaagtgccccactggattctaaggcagttattgtacaatatccatttaaagaacctggaccacctggaactccttttgtgacatcaatctcaaaagatcagatgcttgtgcaatggcatgagccagtgaatgatggaggcaccaaaattattggctaccatcttgaacagaaagaaaagaacagtattttatgggtcaagttaaataagacccccattcaggacaccaaattcaaaacaactgggcttgatgagggccttgagtatgagttcaaagtttctgctgaaaatattgttggcattggcaagcctagcaaagtgtcagaatgctttgttgctcgtgatccatgtgacccacctggtcgccctgaagccattgttattacaagaaacaatgtcacactgaaatggaagaaacctgcctatgatggtggtagcaaaataacaggttatattgtagaaaagaaagatctacctgatggccgctggatgaaagccagctttaccaacgtattagaaactgaatttacagtgagtggacttgtagaagaccaaagatatgaatttagagtaattgcaagaaatgcagctggaaactttagtgaaccatctgatagtagtggtgccattactgcaagagatgaaattgatgcaccaaatgcctctctggatccaaaatataaagatgtcatcgttgttcatgcaggagagacttttgttcttgaagccgacatccgtggcaaacctatacctgatgttgtttggtcaaaagatggaaaagaacttgaagaaacagctgctagaatggaaattaaatctactattcagaaaacaactcttgttgtcaaagactgtatacggactgatggaggacaatatattctgaaactcagcaatgttggtggtacaaagtctatacccatcactgtaaaggtacttgacaggccagggcctcctgaagggcctctgaaagttactggagttactgcggaaaaatgttacctggcatggaacccacctttgcaagatggtggtgctaatatttcacattacatcattgaaaagagggagacaagccgactctcttggacccaggtttcaactgaggtacaggcccttaactacaaagttactaaacttcttcctggtaatgagtacattttccgtgtcatggctgtgaataaatatggaattggagagcccttggaatctgggcctgttacggcctgtaatccttataagccaccaggtcctccctcaacacctgaagtctcagcaatcaccaaagattctatggtagtaacatgggcacgcccagtagacgacggaggtaccgaaattgagggctacattcttgaaaaacgagataaggaaggcgttagatggaccaagtgcaacaagaaaacattaacggatctgcggctcagggtaactggtcttaccgaaggccattcctatgaattcagagttgctgctgaaaatgcagctggtgtgggagaacctagtgagccatctgttttctaccgtgcgtgtgatgccttgtatccaccaggtcccccaagcaatccaaaagtgacggacacttccagatcttctgtctccctggcatggagtaagccaatttatgatggtggcgcacctgttaaaggctatgttgtagaggtcaaagaagctgctgcggatgaatggacaacctgcactccaccaacaggattacaaggaaagcagttcacagtgaccaagcttaaagaaaacactgaatataacttccgtatttgtgccatcaattctgaaggtgtaggtgaacctgcaactctacctggctcagtggttgctcaggagaggatagagccaccagaaatagaactcgatgctgatctcagaaaggtggtcgttctgcgtgcaagtgctactttacgcttatttgtcactatcaaaggtcgaccagaacccgaagttaaatgggaaaaggcagaaggcattctcactgacagggctcagatagaggtgaccagctcatttacaatgttggtgattgataatgttaccagatttgacagtggtcggtataatctgacattagaaaataatagtggctccaaaacagcttttgttaacgtcagagttcttgactcaccaagtgcccctgtgaatttgaccataagagaagtgaagaaagactcagtgacgttgtcctgggaaccaccacttattgatggtggagctaagattacaaactacattgtcgaaaaacgagaaactacaagaaaagcctatgctaccattacaaataattgcactaaaactactttcagaattgaaaatctacaagaaggatgttcttactacttccgagtcttggcttccaatgaatatgggattggtttgccagctgaaacaacagaacccgttaaagtgtctgaaccacccctcccacctggaagagtaactcttgttgatgtgacccgtaatacagctacaattaagtgggagaaaccagaaagtgatggtggcagcaaaattactggttatgtggttgaaatgcagactaaagggagtgaaaagtggagcacctgcacacaagttaagactctagaagcaactatatctggcttaactgcaggagaagagtatgtcttcagggtagctgcagttaacgaaaagggaagaagtgatccaagacaacttggagtgccagtaattgcaagggatattgaaataaagccttcagttgagcttcctttccatactttcaatgtaaaggctagagaacaacttaagattgatgtgccattcaaaggaagacctcaagctactgtgaactggagaaaagatggtcagactcttaaagagacaactagagtcaatgtttcttcttcaaagactgtaacatcactatctattaaggaagcttcaaaggaagatgttggaacttatgaattatgtgtttcaaacagtgctggatccataacagttcctattactataattgtccttgacagaccaggacctccaggtcctatacgtattgatgaggttagttgtgacagcataaccatttcttggaatcctccagaatatgatggtggctgccaaattagcaattacattgttgaaaagaaagaaaccacctctacaacatggcacatagtttcacaagcagttgcaagaacatccattaaaatagttcgcctgacaacaggaagtgagtatcagttccgtgtttgtgcagaaaaccgctatggaaagagctcctacagtgaatcttcagctgttgttgcagagtatccattcagtcccccaggtcctcctggtactcctaaagttgtgcatgccacaaaatctaccatgcttgtaacctggcaagtgccagttaatgatggaggaagtcgagtaattggctatcatcttgagtataaagaaagaagcagcattctttggtcaaaagcaaataaaatcctcattgctgatactcaaatgaaagtctccggccttgatgaaggactgatgtatgagtatcgtgtatatgctgaaaatattgctggaattggtaaatgcagtaaatcttgtgaaccagtccctgcaagagatccttgtgaccctcctggacaacctgaagtcacaaatatcacaagaaaatcagtgtcacttaaatggtctaaaccacattatgatggtggagctaagatcacaggatacattgttgaacgcagagaactaccagatggccggtggctgaagtgcaattatactaatatacaagaaacatactttgaagtaactgaacttactgaagatcagcgttatgaattccgggtttttgcaaggaatgctgctgactcagttagtgagccatctgaatccactgggcctattatagttaaagatgatgttgagcctccaagagttatgatggatgtcaagttccgagacgttattgttgtcaaagctggagaggtccttaagataaatgcagacattgcagggcgacctctgccagtaatttcctgggccaaggatggtatagaaattgaagaaagagcaagaacagaaatcatctcaacagacaatcatactttgttaacagttaaagactgtataagacgagacactgggcaatatgtactaacactgaagaatgttgccggcactcggtctgtggccgttaattgcaaagtacttgataagcctggtccaccagcaggaccacttgaaataaatggcctcactgctgagaaatgctctctttcctggggacgtccccaagaagatggtggtgcagatatcgactattacatcgtagaaaaacgtgaaacaagccaccttgcatggacaatatgtgaaggagagttacagatgacatcctgtaaagtaaccaagttactcaaaggcaatgaatatatatttagagtaactggtgttaataaatatggtgttggtgagcccctagagagtgtagctataaaggcactagatccatttacagttccaagtccacccacgtctttggaaattacttctgtgaccaaagaatctatgacactttgctggtcaagacccgagagtgatggaggtagtgaaatatctggatatataattgaaaggcgagagaaaaatagcctaagatgggtgcgtgtaaacaaaaaaccagtttatgatctaagagtgaaatcaacaggacttcgggaaggatgtgaatatgaatatcgtgtttatgcagaaaatgctgctggcctaagtcttccaagtgaaacctctcccttaattagggcagaagatccagtgttcctaccatctcctccatccaaacccaaaattgtggactcaggcaagacaactataactattgcctgggttaagccgctgtttgatggtggggccccgataactggatatactgtagaatacaaaaaatctgatgacactgactggaaaacttccattcagagcttacgagggacagaatatacaataagcggactaacaacaggagctgaatatgttttcagagtaaaatctgtcaataaggttggtgctagtgaccccagtgatagctctgaccctcagatagcaaaggaaagagaagaagaacctttatttgatattgacagtgaaatgaggaagaccttgattgtcaaggctggtgcctcatttaccatgactgtgcctttccgaggaagaccagtacccaatgtcttgtggagtaagccagacactgacctccgtactagagcttatgttgataccacagactctcgtacatcactgaccattgaaaatgccaacagaaatgactctggaaagtacacattaacaattcagaatgttttgagtgctgcttcactgaccttagttgtcaaagttttagataccccaggtcctccaaccaacattactgtgcaagatgtaaccaaagagtctgcagtgttatcctgggatgttcctgaaaacgatggtggagcaccagtgaagaattaccacatagaaaaacgtgaggccagcaagaaagcatgggtctctgtgaccaacaactgtaaccgcctctcctacaaagttaccaatttacaagaaggagctatctattacttcagagtctctggagaaaatgagtttggtgttggtataccagctgaaacaaaggaaggagtaaaaataacagaaaaaccaagcccacctgaaaaacttggagtaacaagtatatccaaagacagtgtttccctgacctggctgaagcctgaacatgatggcggaagcagaattgtacactatgtcgttgaagcactagaaaaaggacagaaaaactgggttaaatgtgcagtggcaaagtcaacccatcacgttgtttccggtctgagagagaattctgaatactttttccgagtgtttgctgaaaatcaagctggcctgagtgacccgagagagcttctgcttcctgttcttattaaggagcaactagaaccacctgaaattgatatgaagaatttcccaagtcacactgtatatgttagagctggttcaaaccttaaagttgacattccaatctctggaaaaccacttcccaaagtgaccttatcaagagatggtgtcccccttaaggcaaccatgagatttaataccgaaattactgctgagaacctgaccatcaatctcaaagaaagtgttacagctgacgctgggagatatgaaatcactgctgccaactccagtggtacaaccaaagctttcattaacattgttgtgctagacaggcctggtcctccaactggccctgttgttattagtgatataactgaagaaagtgtgactctcaaatgggagccacctaagtatgacggtggaagtcaagttaccaactacattctactcaaaagagaaacaagtactgcagtgtggactgaagtgtctgcaacagttgcaagaaccatgatgaaagtcatgaaactgaccacaggagaagaataccaattccgcatcaaggcagaaaaccgctttggcatcagtgatcatatagattcagcttgtgtgactgtcaaactaccatacacaacacctggaccaccatctacaccatgggtcactaatgttactcgagaaagcatcactgtgggctggcatgaaccagtgtcaaatggaggcagtgcagtcgtaggctatcacctggaaatgaaagacagaaacagtattttatggcaaaaagccaacaaactggtcatccgcacaactcacttcaaagtcacaacaatcagtgctggacttatttatgaattcagggtgtatgcagaaaatgctgctggagttggaaaacctagccatccttctgaaccagtcttggcaattgatgcttgtgaacccccaagaaatgttcgtatcactgatatttcaaagaactctgtcagcctttcatggcaacaaccagctttcgatggaggtagcaagattacaggctacattgttgagagacgtgaccttccagatggcagatggaccaaggccagcttcaccaatgttactgaaactcaattcatcatctctggcttgactcagaattcccagtatgaattccgtgtctttgctaggaatgctgttggttccattagcaatccatctgaggttgtagggcccattacttgcatcgattcttatggtggtcctgtaattgatttgcctctagaatatacagaagttgtcaaatacagagcaggtacatctgtgaagctcagagctggcatttctggcaaacctgcgcctactattgagtggtataaagatgataaagaattacaaaccaatgcactggtgtgtgttgaaaataccacggacctcgcatctatactcatcaaagatgccgatcgccttaatagtggatgctatgaattaaaactaaggaatgccatgggctcagcctcagccaccatcagagtacagatccttgacaaaccaggcccacctggtggaccaattgaatttaagactgtaactgctgagaagatcacccttctctggcggcctccagctgatgatggtggtgcaaaaatcactcactacattgtggaaaagcgtgagacaagccgcgttgtgtggtctatggtgtctgaacatttggaagagtgcatcattacaaccaccaaaattatcaaaggaaatgaatacatcttccgggtccgagccgtgaacaaatatggaattggcgagccactggaatctgattccgttgtagccaagaacgcatttgttacacctgggccaccaggcataccagaagtgacaaagattaccaagaattcgatgactgttgtatggagcaggccaattgcagatggcggtagtgatataagtggctatttccttgaaaaacgagacaagaagagcctaggatggtttaaagtactaaaagagactatccgtgacaccagacaaaaagtaacaggactcacagaaaacagtgactatcaatacagagtttgtgctgtaaacgctgctggacagggtccattttctgaaccatctgaattctacaaagctgctgatcctattgatcctccaggtccacctgctaagataagaatcgcagattcaaccaagtcatccatcacccttggctggagtaagcctgtctatgatgggggcagtgctgttactgggtatgttgtcgagataagacaaggagaggaagaggaatggactactgtctctaccaaaggagaggtcagaactacagaatatgtggtatccaacctgaaacctggagtcaattactacttccgggtatctgctgtaaactgtgctggacaaggagaacctatagaaatgaatgaacctgtacaagctaaagatatacttgaggcaccagagattgacctggatgtggctctcagaacttctgttattgccaaagctggtgaagatgtacaagtgttgattccctttaaaggcagacctccacctactgtcacatggagaaaagatgagaagaatcttggcagtgatgccagatacagcattgaaaacactgattcatcctcattactcaccattcctcaagttactcgcaatgatacaggaaaatatattctcacaatagaaaatggagttggtgaacctaagtcttcaactgtgagtgttaaagtgcttgacacaccagctgcctgccagaaactacaggttaaacatgtttctcgaggcacagtcactttgctctgggatcctcctctcattgatggaggatctccaataattaattatgtcattgaaaagagagatgccaccaagagaacatggtctgtcgtgtcacacaaatgttctagcacatccttcaagctaatagatttgtcggagaagactccattcttcttcagagttcttgcagaaaatgaaattggaattggggaaccctgtgaaactacagagccagtgaaggctgctgaagtaccagctcctatacgtgatctctcaatgaaagactcaacaaagacatctgtcatcctcagctggaccaaacctgactttgatggtggtagcgtcatcacagaatatgttgtagaaaggaaaggtaaaggtgaacagacgtggtcccacgctggcataagtaagacatgtgaaattgaggttagccaacttaaggagcagtcagtcctggagttcagagtgtttgccaaaaatgagaaaggactgagtgatcctgtcactattgggccaattacagtgaaagaacttattattacacctgaagttgacctgtcagatatccctggggcacaagtcactgtgagaattgggcacaatgtgcaccttgaattaccttataagggaaaacccaaaccatccatcagttggctgaaagatggcttgccactgaaagaaagtgaatttgttcgcttcagtaaaactgaaaacaaaattactttgagtattaagaatgccaagaaggagcatggaggaaaatacactgttattcttgataatgcagtgtgtagaattgcagtccccattacagtcatcacccttggcccaccatcaaagcccaaaggacccattcgatttgatgaaatcaaggctgatagtgtcatcctgtcatgggatgtacctgaagataatggaggaggagaaattacttgttacagcatcgagaagcgggaaacttcacaaactaactggaagatggtgtgttcaagtgttgccagaacgactttcaaagttcctaatctagtcaaagatgctgagtaccagtttagagtgagagcagaaaacagatacggagtcagccaaccacttgtctcaagcattattgtggcaaaacaccagttcaggattcctggtcccccaggaaagccagttatatacaatgtgacttctgatggcatgtcactaacttgggatgctccagtttatgatggtggttcagaagttactggattccatgttgaaaagaaagaaagaaatagcatcctctggcaaaaagttaatacatcaccaatctctggaagagaatatagagccactggactggtagaaggtctggattaccaattccgtgtatatgctgaaaattctgctggcctaagctcacctagtgacccaagcaaatttaccttagctgtttctccagtagacccacctggcactcctgactacattgatgtcacccgggaaaccatcacacttaaatggaacccaccattgcgtgatggaggcagtaagattgtgggctatagcattgagaaacggcaaggaaatgaacgctgggtgagatgcaactttactgacgtcagtgaatgtcagtacacagttacaggactcagtcctggggatcgctatgagttcagaataattgcaagaaatgctgttggaactataagcccgccctcacagtcttctggcattattatgacaagagatgaaaatgttccaccaatagtagagtttggccctgaatactttgatggtctcattattaagtccggagagagccttagaattaaagctttggtacaaggaagaccagtgcctcgagtaacttggttcaaagatggagtggaaatcgaaaagaggatgaatatggaaataaccgacgtacttggatccaccagcctatttgttagagatgctactcgggaccatcgtggtgtatacacagtggaagccaaaaatgcatctggttctgcaaaagcagaaattaaagtgaaagtacaagatacaccaggaaaagtagttgggccaataagattcaccaatattactggggagaagatgactctgtggtgggatgccccactcaatgacggttgtgctcccataacccactacatcattgaaaaacgggaaaccagcagacttgcctgggcactaattgaggataaatgtgaagcccaaagttacactgccattaaactaataaacggcaatgaataccaattccgtgtttctgcagttaacaagtttggtgttggcaggccacttgattctgatccagtggttgctcaaatacaatatactgttcctgatgcccctggcattccagaacctagcaacataacaggcaacagcattaccctgacatgggcaaggccagaatcagatggtggcagtgaaattcaacagtatatccttgaaagaagagaaaagaaaagcacaagatgggtaaaagtgatcagcaaacgaccaatctctgaaacaagattcaaagtcactggtctgacagaaggcaatgagtatgaattccatgtcatggctgaaaatgctgcaggagttggacctgcaagtggcatctcaagactcattaaatgtagagagcccgtcaacccaccaggtcctcccacagtggtcaaagtaacagacacatcaaagacaactgtgagcttagaatggtccaaaccagtgtttgatggtggcatggaaataattgggtatattattgaaatgtgtaaggccgacttaggagactggcacaaggtgaatgcagaggcatgtgtgaaaacaagatatacagtcactgatctacaagcaggtgaagaatacaaattccgagttagtgctatcaatggtgctggaaaaggcgacagctgtgaagtgactggcacaattaaagcagttgaccggttaacagctcctgagttagacatagatgcaaacttcaaacagactcatgttgttagagctggggccagtattcgcctcttcattgcctaccaaggtagacctactcctacagctgtgtggagcaaaccagactctaaccttagccttcgggctgatatccatacaacagattccttcagcaccctcactgtggaaaactgcaacagaaatgatgcagggaaatatacccttactgtggaaaacaacagtggtagtaagtcaatcacattcaccgtgaaagtgctagacactccaggcccacctggcccaattaccttcaaagatgtgacccggggatctgctacattgatgtgggatgcccctcttcttgacggtggtgcccgaatccatcattatgtggtagagaaacgagaggcaagtcgccgtagttggcaggttatcagtgaaaaatgcactcgtcagatcttcaaggtcaatgacctggccgaaggtgttccgtactatttccgtgtttctgcagtaaatgagtatggtgttggtgagccctatgaaatgccagaaccaattgtagccacagaacagcctgctccacctaggagacttgatgttgttgatactagcaaatcctccgcagtcttagcttggcttaaacctgaccacgatggaggcagccggatcactggctacctgcttgaaatgagacaaaagggatctgacttctgggttgaagctggtcacaccaaacagctaactttcacagtagagcgtcttgttgagaaaactgaatatgaattccgtgtgaaggccaagaatgatgctggctatagtgaacccagagaagccttctcttctgtcatcattaaggagcctcaaatcgagcccactgctgacctcactggaattaccaatcagcttataacttgcaaagcaggaagcccatttaccattgacgtaccaatcagtggtcgtcctgcccccaaagtaacatggaaactggaagaaatgagacttaaagagacagatcgagtgagcattacaacaacaaaagacagaaccacactgactgtaaaggacagcatgagaggtgactctggaagatacttcttgaccctggaaaatacagctggtgttaaaacatttagcgtcacagttgtggtcattggaaggccaggtccagtaaccggccccattgaggtctcatctgtctcagctgaatcgtgtgtcctgtcatggggagaacctaaagatggaggaggcactgaaattactaattacatagttgaaaagcgtgaatcgggtacaacagcttggcagcttgtcaattccagtgtcaagcgcactcaaattaaagtcactcatctcacaaaatacatggaatattctttccgtgtcagttcagagaacagatttggtgtcagcaaacctctagaatcagcaccaataattgctgaacatccatttgtcccaccaagcgctcctaccagacctgaggtctaccatgtgtctgccaatgccatgtctattcgttgggaagaaccctaccacgatggtggcagtaaaatcattggctactgggttgagaagaaagaacgtaatacaattctttgggtgaaagaaaacaaagtgccatgcttagagtgcaactacaaagtaactggtttagtagaaggactggaatatcagttcagaacttatgcactcaatgctgcaggtgttagcaaggccagcgaagcttcaagacctataatggctcaaaatccagttgatgcaccaggcagaccagaggtgacagatgtcacaagatcaacagtatcactgatttggtctgccccagcgtatgatggaggcagcaaggttgtgggctacatcatagagcgtaagccagtcagtgaggtaggagatggtcgctggctgaagtgcaactacaccattgtatctgacaatttcttcaccgtgactgctctcagtgaaggagacacttatgagttccgtgtgttagccaagaatgcagcaggcgtaattagcaaagggtctgaatctacaggccctgtcacttgccgagatgaatacgctccacccaaagccgaactggatgcccgattacacggtgatctggttaccatcagagcaggttctgatcttgttctggatgctgcagttggtggcaaacctgaacccaaaattatctggaccaaaggagacaaggagctagatctctgtgaaaaagtctctttgcagtatactggcaaacgagcaactgctgtgatcaagttctgtgacagaagtgacagtggaaaatacactttaacagtgaaaaatgccagcgggaccaaggccgtgtctgtcatggtcaaagtgcttgattcccctggcccatgtggaaagctcaccgtcagcagagtaacacaggagaagtgcactttagcctggagccttccgcaggaagacggaggagcagaaatcactcactacatcgtggaaagacgcgagactagcaggctcaactgggtgattgttgaaggcgaatgcccaaccctatcctatgtcgttaccaggctcatcaagaacaatgagtacatattccgagtgagggcagtaaacaaatatggccctggtgtgcctgttgaatcagagccaattgtagccagaaactcattcactattccatcaccacccggcatacctgaagaagttgggactggcaaagagcatatcatcattcagtggacaaaacctgaatctgatggtggcaatgaaatcagcaactacctagtagacaaacgtgagaagaagagcctgcgctggacacgtgtcaacaaagactatgtggtgtatgataccaggctgaaggtgaccagcctgatggagggttgtgattaccagttccgggtgaccgcagtgaatgcagctggtaacagtgagcccagcgaagcttccaacttcatctcatgcagagaaccatcatatacccctggaccaccttctgctccaagagttgtggataccaccaaacacagcattagtttggcatggaccaaacccatgtacgatggtggtactgacattgtaggatatgttctggaaatgcaagagaaggacactgatcagtggtaccgagtgcataccaatgccacaataagaaatactgaattcactgtgccagaccttaaaatgggccagaaatattccttcagagttgctgccgtgaacgtgaagggtatgagcgaatacagcgaatcaattgctgaaattgagcccgtggaaagaatagaaataccagatcttgagcttgcagatgatctaaagaagactgtgaccatcagggctggggcctccttgcgcttgatggtgtctgtatctggaagaccacctcctgtcataacgtggagcaagcagggcattgaccttgcaagccgggcaattattgacaccactgagagctactcattgctaatagtggacaaagttaatcggtacgatgctggaaaatacacaattgaagctgaaaaccaatctggcaagaaatcagcaacagtccttgttaaagtctatgatactcctggtccctgtccttcagtgaaagttaaggaagtatcaagagattctgtgactataacttgggaaattcccacgattgatggtggagctccagtcaacaattacatcgttgagaagcgtgaagctgctatgagagcattcaaaacagtaactaccaaatgcagcaagacactttacagaatttctggacttgtagaaggaaccatgtactatttcagagtgctgccagaaaatatttatggcattggagaaccttgtgaaacatctgatgcagtactggtctcagaagtgcctttggtgcctgcaaagctagaagtggtcgatgtcaccaaatccactgttacccttgcctgggaaaaaccactctacgatggtggtagccgactcactggatatgttctcgaggcctgcaaagctggcacagagagatggatgaaggttgtcaccttaaaacccacagtcctagagcacactgttacttccttaaatgaaggtgaacaatacttatttagaataagggcacaaaatgagaaaggtgtgtcagaaccaagagagactgtcacagccgtgactgtacaagacctcagagtgttgccaacaatcgatctttctacaatgcctcagaagaccatccatgtcccagctggcagaccagtagagctggtgatacctattgctggccgtccacctcctgctgcttcctggttctttgctggttctaaactgagagaatcagagcgtgtcacagttgaaactcacactaaagtagctaaattaaccatccgtgaaaccactatcagagatactggagaatacacacttgaattgaagaatgttaccggaactacttcagaaaccattaaagttatcattcttgacaagcctggtccaccaacaggacctattaagattgatgaaattgatgctacatcaattaccatttcctgggaaccacctgaattggacggtggtgctccactgagtggttatgtggtagaacaacgtgacgctcatcgtccaggatggctgcccgtttctgaatcagtgactaggtccacgtttaagtttaccagactcaccgaaggaaatgagtatgtgttccgtgtggctgcaacaaaccgcttcgggattggctcttacttgcagtctgaggtcatagagtgtcgcagcagcatccgtattcctggacccccagaaacattacagatatttgatgtttcccgtgatggcatgacacttacttggtacccaccagaggatgacggtggctcccaagtgactggatatattgtggagcgcaaagaagtgagagcagatcgatgggtccgtgtaaataaagtacctgtgacaatgacacggtaccgctccactggccttactgaaggcttagaatatgaacaccgtgtcacagccattaatgcaagagggtctgggaaaccaagtcgtccttccaaacccatcgttgccatggatccaattgctcctccaggaaagccacaaaacccaagagttactgatacaacaaggacatcagtctccctggcctggagtgttccagaagatgaaggaggatctaaagtcacaggctacttgattgaaatgcaaaaagtagatcaacatgaatggaccaagtgtaacaccactccaaccaagattcgagagtatactctaacacacctacctcagggtgcagaatacaggttccgcgtcctagcttgtaatgctggtggacctggtgagcctgctgaggtaccaggaacagtcaaagtcactgaaatgcttgaatatcctgattatgaacttgatgaaagataccaagaaggtatctttgtaaggcaaggtggcgtcatcagacttaccataccaatcaaaggaaaaccattcccaatatgtaaatggaccaaggaaggccaggatattagtaagcgtgccatgattgcaacatctgaaacacacactgagcttgtgatcaaagaagcagacaggggtgattctggcacttatgacctggttctggaaaataaatgtggcaagaaggctgtctacatcaaggtcagggtgataggaagtcccaacagtccagaagggccactggaatatgatgacatccaagtccgctctgtgagggtcagctggagacctcctgctgatgatggtggtgctgacatcttaggctacatcctcgagagacgagaagtgcctaaagccgcctggtataccattgattccagagtccgaggtacatctctggtggtaaaaggcctcaaagagaatgtagaataccatttccgtgtttcagcagaaaaccagtttggcataagcaaacccttgaaatctgaggaaccagtcacaccaaaaacaccattgaatcctccagaacctccaagcaatcctccagaagtactcgatgtaaccaagagttctgttagcttgtcctggtcccggcccaaagatgatggtggttctagagtcacaggctactacatcgaacgcaaagagacatccactgacaagtgggtcagacacaacaagactcagatcaccaccacaatgtacactgtcacagggcttgttcccgatgctgagtatcagttccgcatcatcgcacagaatgatgttggcctgagtgagaccagccctgcttctgaaccagttgtttgcaaagatccatttgataaaccaagccaaccaggagaacttgagattctttcaatatccaaagatagtgtcactctacagtgggagaaacctgaatgtgatggtggtaaagaaattcttggatactgggttgaatatagacagtctggagacagtgcctggaagaagagcaataaggaacgtattaaggacaagcaattcacaataggaggtttgctggaagctactgagtatgaattcagggtttttgctgagaatgagactgggctgagcagacctcgcagaactgctatgtctataaagactaaactcacatctggagaggccccaggaatacgcaaagaaatgaaggatgttaccacaaaattgggtgaagctgctcaactctcatgccagattgttggaaggcctcttcctgacattaaatggtacagatttggtaaagagctcatacaaagccggaaatacaaaatgtcttcagatggacgcacacacactcttacagtaatgacagaggaacaggaagatgaaggtgtttatacctgcatagccaccaatgaggttggagaagtagaaaccagtagtaagcttctcctgcaagcaacaccgcagttccatcctggttacccactgaaagagaaatattatggagctgtgggttccacacttcggcttcatgttatgtacattggtcgtccagtacctgccatgacttggttccatggtcagaaacttttgcaaaactcagaaaacattactattgaaaacactgagcactatactcatcttgtcatgaagaatgtccaacgtaagactcatgctgggaaatacaaagtccagctcagcaatgtttttggaacagttgatgccatccttgatgtggaaatacaagataaaccagacaaacctacaggaccaattgtgatcgaagctctattgaagaactccgcagtgatcagctggaaaccacccgcagatgacggaggctcctggatcaccaactatgtggtggaaaaatgtgaggccaaggagggggctgaatggcaattggtgtcttcagccatctcagtgacaacctgtagaattgtgaacctcacagaaaatgctggctattacttccgggtttcagctcagaacactttcggcatcagtgaccctctagaagtgtcctcagttgtgatcattaagagtccatttgaaaagccaggtgctcctggcaaaccaactattactgctgtcacaaaagattcttgtgttgtggcctggaagccacctgccagtgatggaggtgcaaagattagaaattactaccttgagaagcgtgagaagaagcagaataaatggatttctgtgacaacagaagaaattcgagaaactgtcttttcagtgaaaaaccttattgaaggtcttgaatacgagtttcgtgtgaaatgtgaaaatctaggtggggaaagtgaatggagtgaaatatcagaacccatcactcccaaatctgatgtcccaattcaggcaccacactttaaagaggaactgagaaatctaaatgtcagatatcagagcaatgctaccttggtctgcaaagtgactggtcatccaaaacctatcgtcaaatggtacagacaaggcaaagaaatcattgcagatggattaaaatataggattcaagaatttaagggtggctaccaccagctcatcattgcaagtgtcacagatgatgatgccacagtttaccaagtcagagctaccaaccaagggggatctgtgtctggcactgcctccttggaagtggaagttccagctaagatacacttacctaaaactcttgaaggcatgggagcagttcatgctctccgaggtgaagtggtcagcatcaagattcctttcagtggcaaaccagatcctgtgatcacctggcagaaaggacaagatctcattgacaataatggccactaccaagttattgtcacaagatccttcacatcacttgttttccccaatggggtagagagaaaagatgctggtttctatgtggtctgtgctaaaaacagatttggaattgatcagaagacagttgaactggatgtggctgatgttcctgacccacccagaggagtcaaagttagtgatgtctcacgagattctgtcaacttaacatggactgagccagcctctgatggtggcagcaaaatcaccaactacattgttgaaaaatgtgcaactactgcagaaagatggctccgtgtaggacaggcccgagaaacacgttataccgtgatcaacttatttggaaaaacaagttaccagttccgggtaatagctgaaaataaatttggtctgagcaagccttcagagccttcagaaccaaccataaccaaagaagataagaccagagctatgaactatgatgaagaggtagatgaaaccagggaagtctccatgactaaagcatctcactcttcaaccaaggaactctatgagaaatatatgattgctgaagatcttgggcgtggtgagtttggaattgtccatcgttgtgttgaaacatcctcaaagaagacatacatggccaaatttgttaaagtcaaagggactgatcaggttttggtaaagaaggaaatttccattctgaatattgctaggcatagaaacatcttacacctccatgaatcatttgaaagcatggaagaattagttatgatctttgagtttatatcaggacttgacatatttgagcgcattaacacaagtgcttttgaacttaatgaaagagaaattgtaagttatgttcaccaggtctgtgaagcacttcagtttttacacagtcataatattggacactttgacattagaccagaaaatatcatttaccaaaccagaagaagctctaccattaaaatcatagaatttggtcaagcccgtcagctgaaaccaggggacaacttcaggcttctattcactgccccagaatactatgcacctgaagtccaccagcatgatgttgtcagcacagccacagacatgtggtcacttggaacactggtatatgtgctattgagtggtatcaacccattcctggctgaaactaaccaacagatcattgagaatatcatgaatgctgaatatactttcgatgaggaagcattcaaagagattagcattgaagccatggattttgttgaccggttgttagtgaaagagaggaaatctcgcatgacagcatcggaggctctccagcacccatggttgaagcagaagatagaaagagtcagtactaaagttatcagaacattaaaacaccggcgttattaccacaccctgatcaagaaagacctcaacatggttgtgtcagcagcccggatctcctgtggtggtgcaattcgatctcagaagggagtgagtgttgctaaagttaaagtggcatccattgaaattggcccagtttctgggcagataatgcatgcagttggtgaagaaggaggacatgtcaaatatgtatgcaaaattgaaaattatgatcagtctacccaagtgacttggtactttggcgtccgacagctggagaacagtgagaaatacgaaatcacctacgaagatggagtggccatcctctatgtcaaagacattaccaaattagatgatggtacctacagatgcaaagtagtcaatgactatggtgaagacagttcttatgcagagctatttgttaaaggtgtgagagaagtctatgactattactgccgtagaaccatgaagaaaattaagcgcagaacagacacaatgagactcctggaaaggccaccagaatttaccctgcctctctataataagacagcttatgtaggtgaaaatgtccggtttggagtaactataactgtccacccagagcctcatgtaacatggtataaatcaggtcagaaaatcaaaccaggtgacaatgacaagaagtacaca

SEQ ID NO: 1157 - DNA, 100000 bp, Homo sapiens
acaggattgctgagctgggctttctccaataataacatgatcaaaataaaataaaagaagtccttttggcctctgacatcacatcctggagtggatgatttaccagttggtcatctgctgtgctgcaggaatgaatgtagctactgtggtatgaagcaaaattctaacgttcctagaaagtgttagacctgtcaacctccaggaaggatgagatctgcttccacactgcacagtgtccagaagatcaggaccatgtgtcacttggttcaaagatgacttctaagtggtacctggagatactgaatgcctagaaagatgacaactcaagcaccgacgtttacgcagccgttacaaagcgttgtggtactggagggtagtaccgcaacctttgaggctcacattagtggttttccagttcctgaggtgagctggtttagggatggccaggtgatttccacttccactctgcccggcgtgcagatctcctttagcgatggccgcgctaaactgacgatccccgccgtgactaaagccaacagtggacgatattccctgaaagccaccaatggatctggacaagcgactagtactgctgagcttctcgtgaaagctgagacagcaccacccaacttcgttcaacgactgcagagcatgaccgtgagacaaggaagccaagtgagactccaagtgagagtgactggaatccctacacctgtggtgaagttctaccgggatggagccgaaatccagagctcccttgatttccaaatttcacaagaaggcgacctctacagcttactgattgcagaagcataccctgaggactcagggacctattcagtaaatgccaccaatagcgttggaagagctacttcgactgctgaattactggttcaaggtgaagaagaagtacctgctaaaaagacaaagacaattgtttcgactgctcagatctcagaatcaagacaaacccgaattgaaaagaagattgaagcccactttgatgccagatcaattgcaacagttgagatggtcatagatggtgccgctgggcaacagctgccacataaaacacctcccaggattcctccgaagccaaagtcaagatccccaacaccaccgtctattgctgccaaagcacagctggctcggcagcagtccccatcgcccataagacactccccttccccggtcagacacgtgcgggcaccgaccccatctccggtcaggtccgtgtctccagcagcaagaatctccacatcccccatcaggtctgttaggtctccattgctcatgcgtaagactcaggcatccaccgtggccacaggtcctgaagtgcctcccccttggaagcaagagggctacgtggcctcctcatctgaggctgagatgagagagacaacgctgacaacctctactcagatcaggacagaagagagatgggaagggagatacggtgtccaggagcaagtgaccatcagtggtgctgcgggtgctgccgccagtgtgtcggccagtgctagctacgcagcagaggctgttgccactggtgctaaagaggtgaaacaagatgctgacaaaagtgcagctgttgcgactgttgttgctgccgttgatatggccagagtgagagaaccagtgatcagcgctgtagagcagactgctcagaggacaaccacgactgctgtgcacatccaacctgctcaagaacaggtaagaaaggaagcggagaagactgctgtaactaaggtagtagtggccgccgataaagccaaggaacaagaattaaaatcaagaaccaaagaagtaattaccacaaagcaagagcagatgcacgtaactcatgagcagataagaaaagaaactgaaaaaacatttgtaccaaaggtagtaatttccgcagctaaagccaaagaacaagaaactagaatttctgaagaaattactaagaaacagaaacaagtaactcaagaagcaataagacaggaaactgagataactgctgcatccatggtggtagttgccactgcaaagtccacaaaactagaaacagtcccgggagctcaagaagaaactaccacacaacaagatcaaatgcacctaagttatgaaaagataatgaaggaaactaggaaaacagttgtacctaaagtcatagttgccacacccaaagtcaaagaacaagatttagtatcaagaggtagagaaggcattactaccaaaagagaacaagtgcaaataactcaggagaagatgagaaaggaagccgagaaaactgccttgtctacaatagcagttgctactgctaaagccaaagaacaagaaacaatactgagaactagagaaactatggctactagacaagaacaaatccaagttacccatggaaaggtggacgttggaaaaaaggctgaagctgtagcaacagttgttgctgcagtagaccaggcccgagtcagagagcccagagagcctgggcatcttgaagaatcctatgctcagcagaccactttggagtacggatataaggaacgcatttccgccgcaaaggtagctgagcctccccaacgtccagcctcagaaccccacgttgtccctaaagcagtcaagcctagagtaatccaggctccttctgagactcatatcaaaactactgatcaaaagggaatgcacatatcatcacagatcaagaaaactacagatctaacaacggaaagattagtccatgtggataaacgcccccgcacagctagccctcactttactgtttcaaaaatttctgttcctaagacagaacatggatatgaggcatcaatagccggtagtgctattgccacattacaaaaagagttgtcagccacatcttctgctcagaagatcaccaaatcggtgaaggctcctactgtgaagcccagtgagactagagtaagggcagagcccacacccttgccacagttccccttcgctgacacaccagatacttacaagagtgaagctggcgttgaggtgaaaaaggaagtaggggtgagcatcactggcaccaccgtccgtgaagagcgctttgaagtactgcacggacgcgaagccaaggtaacagaaacagcaagagtaccagcacctgttgaaattcctgttactccaccaactttggtctcgggcttaaaaaatgtgactgtcatagaaggtgaatctgtcaccttggagtgccacatctctggatacccatccccgacagtgacatggtacagggaagactaccaaatcgaaagttccattgacttccagataaccttccagagtggaattgctcgtcttatgattcgcgaagcatttgcggaagacagcgggcgatttacttgcagtgctgtaaatgaggctggaaccgtcagcacatcctgctatctggctgtgcaggtgtcagaagaatttgaaaaggaaaccacagccgtgactgagaaatttactacagaagagaaacgctttgttgagtcaagagatgtggttatgactgatactagcctcacagaggaacaagcagggcctggagaacctgccgcgccttactttattacaaaaccagtggtccagaaactggtggaaggtgggagcgtggtgtttggatgccaagttggcggcaacccaaagccccatgtatactggaaaaaatctggtgttcctctaaccactggatacagatacaaagtgagttacaacaaacaaaccggtgaatgcaagctggtgatttctatgacttttgctgatgatgctggagaatacactattgttgttcgcaataagcatggagaaacttctgcatctgcttccttgcttgaagaagctgattatgagttactgatgaagtcccagcaagaaatgctttatcagacacaagtgactgcatttgttcaagaacctaaagttggagaaacagcacctggatttgtatactctgagtatgaaaaagagtatgaaaaagaacaagccttaattaggaagaaaatggccaaagatactgtagtggtcagaacttatgtagaagatcaggaattccatatttcttcctttgaagagagacttattaaagaaattgaatatagaataataaagactacattagaagaacttcttgaagaagatggagaagaaaagatggcagttgacatttctgaatctgaagctgttgaatcaggatttgatttaagaatcaagaattatagaattcttgaggggatgggtgtcacttttcattgcaagatgtctggatatccattaccaaagattgcttggtacaaagatggcaagcgcatcaaacatggagaaagataccaaatggactttctacaagatggcagagctagtctgcgtatacctgttgttcttccagaagatgaaggaatctacactgcatttgccagcaatattaaaggaaatgcaatttgctcagggaaattgtatgtggagcctgctgcaccacttggagctccgacttacattcccacactagagccagtgagcagaatcagatctctctctccacgttcagtgagcaggtctcctatacgcatgtctcctgcacggatgtcacctgcaaggatgtctcctgcacggatgtcccctgcaagaatgtcccctggacgtaggctggaggagacagatgagtcacaacttgagagactatataaaccagtctttgtgttaaaacctgtttctttcaaatgtttagaagggcaaactgccagatttgacttaaaggttgttggtagacctatgccagagacgttctggtttcatgatggccagcaaattgtcaatgactatacccataaagtagtcattaaagaagatggtactcaatcactaattattgtccctgccacacccagtgattctggggaatggactgtggttgcccaaaacagggcaggcagatcttcaatttcagtgattttaactgtggaagctgtggaacatcaggtaaaaccgatgtttgtagaaaaactgaaaaatgtcaatataaaggaaggttcccgacttgaaatgaaagtcagagctacgggtaaccccaaccctgacattgtatggttgaaaaacagtgacatcattgtgcctcataaatatcccaaaatcagaattgaaggaaccaagggagaagctgcccttaaaatcgattccactgtcagccaagattctgcctggtatactgcgactgctattaataaagctggcagagacactacaagatgcaaagtaaatgttgaagttgagtttgcagagcctgagccagagagaaagttaatcatcccacgggggacatatagagcaaaggagattgcagccccagaactggagcccctccatttgcgatatggccaagagcaatgggaagaaggtgatctctatgacaaagagaaacaacagaaaccatttttcaagaaaaaactcacttccttaagacttaagcgctttgggcctgcccactttgaatgcaggctaacacccattggtgacccaacgatggtggtggagtggctccatgatggaaagccacttgaagcagccaacaggctccgtatgatcaatgaatttgggtactgcagccttgattatggcgttgcatattctagagacagtggtatcattacttgcagagccactaacaaatatggaacagatcacacatctgctacccttattgttaaagatgagaaaagtcttgtggaagaatcccaattgcctgaggggaggaaaggcttacagagaattgaagaattagagagaatggctcatgaaggtgcacttacaggtgtaacaacagatcagaaagaaaagcaaaagccagacattgtcttgtacccagagccagttagagtacttgaaggggagactgcaaggttccgctgcagggtaacaggctaccctcagcccaaagtcaactggtacctcaatggacagctcatccgcaaaagcaaaaggttcagagttcgctatgatggtatccattacctggacatcgtggactgcaaatcatatgacacaggtgaagtgaaggtcaccgcggaaaatcctgaaggtgtgatagagcataaagtgaagcttgagattcaacagagggaagattttaggtctgtccttaggagagctcctgaaccaaggcctgagtttcacgtacatgaaccaggaaagcttcagtttgaagtacaaaaagtggatagacctgttgacaccactgaaaccaaagaagttgtgaagttgaaaagggctgaaagaattacccatgaaaaagtgcctgaagagtcggaagagctgcgcagtaaattcaagcgcagaacagaagagggctattatgaagccattaccgctgtggagctcaagtctcgaaagaaggatgaatcctatgaggaactcctcaggaagacaaaagatgaacttctccactggaccaaagagttaactgaagaggaaaagaaagctcttgccgaagaaggcaaaatcacgattccaacttttaaacctgacaagattgaactaagtcctagtatggaggctccaaaaatcttcgaaagaatccagagccaaacagtgggccaaggatctgatgcacacttccgggtcagagtcgtggggaaaccagaccccgaatgtgaatggtacaaaaatggtgtcaaaattgaacggtctgaccggatctactggtactggcccgaagacaatgtttgtgaattggtcataagagatgtgactgctgaggactctgccagcatcatggtaaaagccatcaacatagctggagaaacctccagtcacgcattcttacttgtccaagccaagcaattgatcactttcacacaggaattacaagatgttgttgctaaggaaaaagacactatggcaacctttgaatgtgaaacttcagaaccatttgtcaaagtgaaatggtataaagatggtatggaggttcatgagggagataaatacaggatgcactctgacagaaaggttcacttcctctccatactgaccattgatacgtctgatgctgaagattacagctgtgtacttgtggaagatgaaaatgtcaaaacgactgctaaacttattgttgaaggtgcagttgttgagtttgtgaaagaacttcaggacatagaagttccagaatcatattcaggagaattagagtgcattgtatccccagaaaatatagaaggaaaatggtatcataatgatgtggagcttaaatccaatggcaaatatacaattacatctcgtcgtggacgtcagaacctcacggtcaaggatgtaaccaaggaggaccagggagaatacagctttgtcatcgacgggaaaaagacaacctgtaaattaaagatgaaaccccgccccattgctatcctacaaggacttagtgaccaaaaagtctgtgagggtgacattgttcagcttgaagttaaagtctccttggaaagtgtggaaggcgtctggatgaaagacggccaagaagtgcagcccagtgacagggttcacattgtgatagacaaacaatctcatatgctgctcattgaagacatgactaaggaagatgctggaaattactctttcaccattccagcccttggcctctccaccagtgggcgtgtctctgtctatagtgtggacgtgataacacctctaaaagatgttaatgtgattgaaggcaccaaggctgtgcttgaatgtaaggtgtcagtccctgatgtgacttctgttaagtggtacttaaatgatgaacaaatcaagcctgatgaccgtgtacaggccattgtgaaaggtactaaacagcgactagtcattaaccgaactcatgcttcagacgaaggaccttacaagctgatagttggcagagttgaaaccaactgtaatctctctgtagaaaaaattaaaattatcagaggtcttcgtgaccttacctgtacagaaactcaaaatgtggtgtttgaggttgagctgtcccactctggaattgatgtcctgtggaattttaaggacaaggaaatcaagcccagttctaaatataaaattgaagcacatggaaaaatatataaattgacagttctaaatatgatgaaagatgatgaaggaaaatacacattttacgcgggagaaaatatgacatctggaaaacttactgtggcaggtggggccatctccaagccactcacagatcagaccgtagctgaatcccaggaagctgtgtttgaatgtgaagttgccaacccagattccaaaggcgaatggttgagggatggcaaacacctaccactgactaacaacatcagaagtgagtctgatggccacaaaaggagacttatcattgctgccaccaaattagatgacattggagaatatacctacaaggtggccacctccaaaacatctgccaaactcaaagttgaagctgtcaaaattaagaagactctgaagaacctcacagtgacagaaacacaggatgctgttttcactgtcgagcttacacaccctaatgtcaaaggtgtccagtggatcaaaaatggagttgtgctggaatccaatgaaaagtatgctatctctgtcaaaggaacaatttactctctgaggattaaaaactgtgccatcgtggatgagtctgtttatggcttcaggcttggaaggcttggagccagtgccagactgcacgtggagactgtcaagatcattaaaaagccaaaggatgtgacagccttggaaaatgccactgttgcctttgaagttagtgtttcccatgacactgttccagtaaaatggttccataagagtgtggaaattaagccaagtgacaaacacagactggtctcagaaaggaaagtccacaagctgatgctgcagaacatctccccctcagatgctggggaatacacagctgtggtcgggcaattggaatgcaaagcaaaactgtttgtggagacattacatattacaaaaaccatgaaaaatatcgaggtgcctgagaccaaaactgcctcttttgagtgtgaggtgtcccacttcaatgtcccttccatgtggctgaagaatggtgtggaaattgagatgagtgaaaagttcaagatagttgtgcagggaaaactccatcagctgatcatcatgaacaccagcacagaggactcggcagaatacacatttgtctgtggcaatgaccaagtcagtgccaccctgacagtcaccccaatcatgattacttccatgctgaaagacatcaacgctgaagaaaaagacactattacttttgaggtgacagtgaactatgaaggcatctcttacaaatggttaaagaatggtgtggaaatcaaatcaactgacaagtgccagatgagaaccaaaaagctcacacactcactgaacatcaggaatgttcactttggggatgctgctgactacacctttgtggctggaaaagcaacatcaacagccacactttatgtggaagctcgtcatatagaatttaggaaacacattaaggacattaaggtactggagaagaagcgagccatgtttgaatgtgaagtttctgaacctgacatcactgtacagtggatgaaagatgaccaggaactgcagatcacagacagaataaagattcagaaggagaaatatgtccaccgccttctgatcccatccacccggatgtctgatgctgggaagtacacagtggtggcaggaggcaacgtgtcaactgcaaaactctttgtagaaggcagagatgttcgcatccgaagtattaaaaaggaggttcaggtcattgagaaacagcgtgctgttgttgaatttgaggtcaatgaagacgatgttgatgcccactggtataaagatggcattgaaatcaatttccaagttcaagaacgacacaaatatgtagtggaaagaagaatccaccgaatgtttatctctgagaccagacagagcgatgcaggagaatacacctttgtggcaggaaggaacaggagttctgtcactctctatgtcaatgctcctgaaccgccccaagttctgcaggagctccagcctgtcactgtgcagtctggcaagcctgcccgcttctgtgccatgatatccggaagaccacagcccaaaatttcctggtacaaggaagagcagctgctttccactggcttcaagtgcaaatttcttcatgatgggcaagagtacacgcttttgctaattgaagccttcccagaggatgcggcagtctatacctgtgaagccaagaatgactatggtgttgccacaacatcagcttcactctcagtggaagttccagaagttgtgtctcctgatcaggaaatgcctgtttatccacctgccatcatcaccccgcttcaggacactgtcacttctgaagggcagccagcccgttttcaatgccgggtttctggaacagatctaaaagtgtcgtggtacagcaaagacaagaaaatcaagccatctcggttctttagaatgactcaatttgaagacacttatcaactggaaattgccgaagcttatccagaagatgaaggaacttacacgtttgttgctaataatgctgtaggccaagtatcaagcacagccaacctgagtctggaagctcctgaatcaattttgcatgagaggattgaacaagagattgagatggaaatgaaagagttttctagttcttttctgtctgccgaggaagaaggacttcatagcgccgaacttcaattatctaaaataaatgaaacacttgaacttttgtctgaatctccagtttacccaactaaatttgattccgaaaaggaaggcactggcccaattttcatcaaagaagtgtcaaatgctgatataagcatgggggatgtggctacactgtctgtaactgtcattggcatccccaaacctaaaattcagtggttctttaatggagtgctattaaccccttctgctgactacaaatttgtttttgacggtgatgatcatagcctgatcattctgttcaccaaattggaggatgagggagagtatacatgtatggccagtaatgactatggaaagacaatatgtagtgcctatctaaaaattaattccaaaggagagggtcacaaagacactgaaacagaatcagcagtggcaaaatctctggaaaagctgggaggtccttgtcctcctcacttccttaaggagttaaaaccaattcgctgtgctcaagggcttcctgccatctttgagtacacagtggttggagagcctgcccctactgttacatggttcaaagaaaacaagcagctttgcaccagtgtttattacactatcattcataaccctaatggctctggaactttcattgtcaatgaccctcagagggaagacagtggcctctatatctgtaaagcagagaatatgttgggtgagtccacctgtgcagcagagctgcttgtgcttctggaagacacagacatgactgataccccctgcaaagcaaagtccacaccagaggctcctgaggattttccacagacacccttaaagggtcccgcagttgaagcacttgactcagagcaggaaattgcaacgtttgtaaaagacaccattttgaaagctgctttaattacagaagaaaaccagcaactatcttatgagcatattgctaaagccaatgaattgagcagtcagcttcctttgggagctcaggaattgcaatccattttggagcaagacaagctcactcctgaaagcaccagggaatttctttgcatcaatggcagtattcactttcagcctctcaaggaaccatctcccaacctacagctgcagattgtacagtcccagaaaaccttctccaaagaaggtattctaatgcctgaagagcctgagacacaggcagttctatcagataccgagaaaatcttcccaagtgccatgtccatagaacaaattaattcattaacagttgagcctctgaaaactttattagctgaacctgaagggaattatccacagtcttcaatagaacctccaatgcattcttatctaacctctgtggctgaggaagtactttcaccaaaagaaaagacagtatctgacaccaacagagagcaaagagtgactcttcaaaagcaagaggcacaaagtgcgctcatcttgagtcagagcttagctgagggacacgtggagagtctccagagtcctgatgtcatgatctctcaggtaaactatgagcccctagtcccttcagaacactcatgcacagaaggaggtaaaattttgatagaaagtgcaaatccactggaaaatgcagggcaagattctgcggtcagaattgaggaaggcaagtccttaagatttccactagcacttgaagaaaagcaggtactgctcaaagaagagcattctgacaacgtggtgatgcccccagaccaaatcattgagtctaaaagagagcccgtggcaataaagaaagtgcaggaggtacagggaagggaccttctttctaaggaaagcttgctttctggtattccagaagagcagagattaaacctgaaaattcaaatctgccgggctttgcaagcagccgtggccagcgagcagccaggtcttttctctgagtggctaagaaatattgaaaaggtggaggtcgaggctgtaaacatcacccaagagcccagacacatcatgtgcatgtaccttgttacttcggcaaagtctgtaacagaagaagtaaccatcattattgaagatgttgatcctcaaatggctaacctgaaaatggaacttagggatgctttgtgtgctattatatatgaggaaatagacatcctaacagctgagggtcctagaattcagcaaggagccaaaacaagtttgcaagaagaaatggattctttttcaggttcacagaaggttgaacccattactgaaccagaagttgaatctaaatatctgatctcaactgaagaggtcagttattttaacgtgcaaagtagggttaaatatttggatgccacacctgtcactaaaggggttgcttcagctgttgtctctgacgaaaaacaagatgagagtctgaaaccatcagaggaaaaagaggagtcttcctctgaaagtggtactgaggaggttgctacagtaaagatacaggaagctgagggtggcttaatcaaagaggatggccccatgatacatacacctttagtggacactgtttctgaggaaggtgatattgtacacctcacaacatccataacaaatgctaaagaggtgaattggtattttgagaataaactggtgccttcagatgaaaagttcaagtgtttacaagatcaaaatacatatacgctagtcatcgacaaagtaaataccgaagaccatcaaggagagtatgtctgtgaggccttgaatgacagcggaaaaacagcaacttcagccaaactcactgtagtaaaaagagctgccccagtgatcaagaggaaaatcgaacccctggaagtagcactgggccacctagccaaattcacctgtgagatccaaagtgctcccaatgtccggttccagtggtttaaagctggccgagaaatttatgagagtgacaagtgttctattcgatcttcaaagtatatctccagccttgaaatcctgagaacccaggtggttgactgcggcgagtatacatgcaaagcttccaatgagtatggcagtgtcagctgtacagccacactaactgtgacagaggcatatccaccaacctttctctccagacctaagtcccttacaacttttgtgggtaaggcagccaagttcatctgcacagtgacagggactcctgtgatagaaaccatttggcagaaagatggtgctgcactctcaccttcacctaactggaggatttccgacgcagaaaacaaacacattttagaactctcaaaccttaccattcaagatagaggagtttattcttgtaaggcttctaacaagtttggagcagacatctgccaagcagagttgatcatcattgataagccacatttcattaaagaattagagcctgtgcagtccgctatcaataagaaggtccaccttgagtgccaagtagatgaagacagaaaagtcacagttacgtggagcaaagatgggcaaaaactccccccagggaaagattataagatctgttttgaagataaaatagcaacacttgagattcctttggccaaactgaaagattcaggaacctatgtctgtacagcttcaaatgaggctggaagcagctcctgctcagccacagtcactgtcagagagccaccatccttcgtgaagaaggtggatccctcttatttaatgctcccaggtgaatcagcacgcctccattgcaagctgaaaggctcacctgtgatccaggttacttggtttaaaaataacaaagaactcagtgaaagtaacacagtccgaatgtattttgtcaattctgaggctatacttgatattacggatgtaaaagttgaagacagtgggagttactcatgtgaagcagtgaatgacgtcggcagtgatagctgcagtactgaaatagttatcaaagaacctccttctttcatcaaaactcttgagcctgcagacatagtgagaggaacaaatgctctacttcagtgtgaagtctcaggcactggaccatttgaaattagctggttcaaagacaagaaacaaattcgaagtagtaaaaaatacagattgttttctcagaagtctcttgtgtgtctggagatcttttcgtttaatagtgcagatgttggtgaatatgaatgtgttgttgctaatgaagtcggcaagtgtggctgcatggcaacccacttactcaaagaacctccaacctttgtaaagaaagtagatgatttgattgcactaggaggacaaaccgttaccctgcaagctgctgtgagagggtcagagcccatttctgtcacatggatgaaaggtcaagaggtcatcagagaagacggaaaaatcaaaatgagcttttccaatggtgttgcagtcttgataatccctgatgttcagattagttttggaggcaaatacacgtgcctggctgaaaatgaagctggaagccaaacatctgttggggaattaatagttaaagaacctgccaaaatcattgagcgagcagaactgatccaggtgacagcaggagatcccgccacactggagtacacagtggcaggcacgccagaactgaagcccaaatggtacaaagatgggagacccttggtcgccagtaaaaaataccgaataagttttaaaaacaatgttgcccagctcaaattttattcagctgagctgcacgacagtggccaatacacatttgagatttccaatgaagtgggcagcagctcctgtgagactacattcactgtattagatcgagacattgctccattttttaccaaacccttgcgcaacgtggatagtgttgttaatggtacctgcagactggactgcaaaattgcaggctccctccccatgagggtgtcctggtttaaggatggcaaagaaatagctgcttctgacagatacaggatagcatttgtggaaggcacagcctctttggagatcatcagagtagacatgaatgatgcagggaatttcacttgtcgagccacaaattccgtgggaagcaaagacagcagtggagccctgattgtgcaagaaccacccagttttgtaactaaacccggctcaaaggatgttctgcctggctcagcagtctgcctgaagagcactttccaaggatctactcctctcacaatcagatggtttaagggcaacaaagagctggtttctggtggaagctgctatattaccaaagaagctttagagagttccctggaactctatttagtaaaaacctctgattcgggcacgtacacatgtaaagtcagcaatgtcgctggaggggtggaatgcagtgcaaacttgtttgtaaaagaacctgccacatttgttgaaaagttagagccatcacagctgttaaagaagggagatgccacccagctagcctgcaaagtaactggtacccctccaattaaaataacatggtttgcaaatgatagagaaattaaggagagcagcaaacacagaatgtcttttgtggagtctactgcagttctaagactgacagatgttggcatcgaagacagtggtgaatatatgtgtgaggcccaaaatgaggctggcagtgaccactgcagtagcattgtaatagtcaaagagtcaccttattttaccaaggaatttaagccaattgaagtcttaaaggagtacgatgtcatgttgctggctgaggtggcaggcactcctccctttgagatcacttggttcaaagataacacaatcctgcgaagtggtagaaagtataagactttcattcaggatcatctggttagcctgcagatcctcaagtttgtagctgcagatgctggcgaataccagtgtcgggtgaccaatgaggtgggcagcagcatctgcagtgccagggtgactttaagagaacccccatccttcataaagaagatcgagagtaccagctccctccggggaggcacagctgccttccaggccactctgaagggctccttgccaattacggtgacttggctaaaagacagcgatgaaatcactgaagacgataatataagaatgacctttgagaacaatgtggccagtttgtacctcagtggcattgaagtcaagcatgatgggaaatatgtctgtcaggccaaaaatgatgcaggaatacaaagatgttctgcattactctcagtaaaagaacctgcaacaatcaccgaggaagctgtgtctatagatgtcacccaaggagacccagccactttgcaggttaaattttcagggactaaggagattacagccaaatggtttaaagatggccaagaactgaccctgggctcaaaatataaaatcagtgtcactgatacagtctcaatactgaagattatttctacagaaaagaaagatagtggagaatatactttcgaggtccaaaatgatgttgggaggagcagctgcaaggctagaattaatgtattagatcttatcatacctccttcattcaccaaaaagctgaagaaaatggacagcattaaaggttctttcattgatttagaatgtatagtggctgggtcacatcccataagcatccagtggttcaaagatgaccaagaaatatcagctagtgaaaagtacaaattctcttttcatgacaatactgccttcttggaaatcagccagctggaaggtacagacagtgggacatacacttgttctgccacaaataaggcagggcacaaccaatgcagtgggcatctgacagtcaaagaacccccttactttgtggaaaagccacagtcacaagatgtcaatcccaacacaagggtacagttaaaggctcttgtgggtggcactgcacccatgacaataaagtggtttaaagataacaaagagttacactcaggagcagcccgctcagtttggaaggatgacacctctaccagtctagagctctttgcagccaaagctaccgattctggaacctacatttgccaactaagcaatgatgttggcacagcaaccagcaaagccactctctttgtaaaagaacctcctcaattcattaagaagcccagtccagtcttagtgctgaggaatggacagtcaacaacatttgaatgccaaataacaggcactcctaaaatccgagtgtcttggtatctagacgggaatgaaataacagccattcagaaacatggcatttccttcattgatggtttagccactttccagatttctggtgccagggtagaaaatagtgggacttatgtgtgtgaagctcgaaatgacgcaggcacggcgagctgcagcattgaactcaaagtgaaagaaccccccacctttatcagagagctgaagcctgtggaggtagtaaaatatagtgacgtggagctggagtgtgaagttacgggaacacctccgtttgaagtcacttggctgaagaataacagggaaattcgaagcagcaaaaaatacacattgaccgacagagtgtctgtgtttaacctccatataaccaagtgtgacccttcagacactggggaataccagtgcattgtatccaatgaaggcggcagctgctcatgcagtactagagttgccctgaaagaaccaccatcattcattaagaagatagaaaataccactactgttttgaaaagttctgccacctttcagagtaccgtggcaggttctcctcctatttctataacctggctaaaggatgatcagattcttgatgaagatgataatgtctatatttcatttgtggacagtgtggccacacttcaaatcagaagtgtggataatggacacagtgggagatatacctgtcaagccaagaatgagtcaggagttgagaggtgttatgctttccttttagtacaagaaccagctcaaatcgtagagaaagctaaatcagttgatgttacggagaaagatcccatgaccttggaatgtgttgtggctggaacaccagaactcaaagtgaaatggcttaaagacgggaaacaaatagttcccagtagatacttttcaatgagttttgaaaataacgtggccagttttagaattcagtcagtaatgaagcaggacagcggtcagtacactttcaaggtggaaaatgacttcggaagcagtagctgtgatgcctacttaagagtgctagatcaaaatattcctccatcattcaccaaaaaattaaccaaaatggataaagttctgggctcttctattcatatggagtgcaaggtgtctggttcacttcccattagtgctcagtggtttaaggatggaaaagaaatatctacaagtgcaaaatacagacttgtgtgccatgagagatctgtgtctctggaagttaataatctggaattagaagatactgcaaattacacatgcaaagtgtcaaatgtagcaggagatgatgcatgcagtggcatcttaactgtgaaagaaccaccaagcttcctagtgaaacctgggcgacagcaagccatacctgattctacagtggaatttaaggcaatactaaaaggaacaccaccatttaaaataaaatggtttaaggatgatgtggaacttgtctcaggtcctaaatgtttcattggcttggaagggtcgactagcttcttaaatctctactcagtggatgcttctaagactggacagtatacttgccatgttaccaatgatgttggtagcgactcttgtactacgatgttgcttgtgacagaaccaccaaagtttgtaaagaaattagaagcctccaaaattgtgaaagcaggtgactcttcacgacttgaatgcaagatagctggatccccagaaatcagagttgtgtggttccgaaatgaacatgaacttccagccagtgataagtacagaatgactttcattgactcagtggccgtcatacagatgaacaatctcagtactgaggacagtggagatttcatttgtgaggctcagaatcccgctggcagcacaagctgcagtaccaaggttatagtaaaagagccacctgtttttagcagcttccctcctatagtagaaacccttaaaaatgctgaagtcagtcttgaatgtgaactttcgggaacaccaccgtttgaggtggtatggtacaaagacaagcggcaactcagaagcagcaagaaatacaagattgcatccaaaaacttccacacaagtattcacattctcaatgtggacacttcagacatcggtgaataccactgcaaagcacagaatgaagtgggaagtgatacttgtgtttgtactgtaaaattgaaagaaccaccaagatttgtctccaaactgaacagcctcactgttgtagccggagagcctgctgaattacaagcatccatagaaggcgcccagcctatttttgtccagtggcttaaagagaaggaagaagtgattagagaaagtgaaaacatcaggattacatttgtggaaaatgttgcaactctacagtttgcaaaagcagagccagctaatgctggaaagtatatctgccaaatcaagaatgatggtggaatgagggagaacatggccacactgatggtcttagagcccgcagtcattgttgagaaggcaggaccgatgacggtgactgtaggagaaacgtgcactctggagtgtaaggtggctggcactccggaactctctgttgaatggtacaaggatggaaagctgttgaccagcagccaaaaacacaaatttagcttctacaacaaaatctcttccttaaggattctctcagttgaaaggcaagatgcaggcacatacactttccaggttcaaaataatgttgggaaaagcagctgcacagctgtggttgatgtttcagaccgagcagttcctccctctttcacacgaagactgaaaaatactggtggggtgttaggtgcttcttgcatcttggaatgcaaagtagctggatcatcacctatttcagttgcctggtttcatgagaaaaccaagattgtcagtggagcaaagtaccaaaccacattttcagataatgtctgcacattgcagttgaattctctggattcctcagatatgggcaattacacatgcgtggctgctaatgtcgctgggtctgatgaatgtcgtgcagtgctaactgtacaagaaccaccctcttttgtgaaagaacctgaacctttggaagtactaccaggcaaaaatgtaaccttcacaagcgttattagaggaacccctccattcaaagtcaactggttcagaggtgccagagaactagtgaaaggagaccggtgcaacatctattttgaagacactgtggcagaactggaattatttaatattgacatatctcagagtggggaatacacctgtgtggtttctaacaacgctggccaagcatcttgcactacccgtctctttgtgaaagaaccagctgcatttttgaagagattaagtgatcattctgtagaaccagggaagtccataattctggagagcacctacactggaacacttccaatttctgtcacttggaaaaaggatggttttaacataactacctctgaaaaatgtaacatagtcacaacagagaaaacttgtatcctggaaattctgaatagcacaaaaagagatgcagggcagtattcctgcgagattgaaaatgaggcaggaagggatgtttgtggagctctggtatctacattagaaccgccttattttgttacggaactggaacctctggaggcagcagttggagattcggtttctttacaatgccaagttgctgggacaccagaaattacagtgtcttggtacaaaggagataccaaattacggccaactcctgaatacaggacctactttacaaacaatgtggccacacttgtttttaataaagtgaacatcaatgacagtggagagtacacatgcaaagcagaaaatagtataggaactgcttcttctaagactgtgttcagaattcaagagcgccaactcccaccttcttttgcaagacaattaaaggacattgaacaaactgtggggttacctgttacactcacttgtcgattaaatggctctgcacccatccaagtgtgctggtatagagatggagtacttttaagagacgatgaaaatctacagacttcatttgtagataatgtggcaactttaaaaattttgcaaactgacttgagtcactctggccagtactcttgctcagcttccaacccacttggaacagcatcttctagtgctagactcacagcaagagaacccaagaaatctcccttctttgacatcaagcctgtatctatagatgttattgctggagaaagtgctgattttgagtgtcatgttactggtgctcaaccgatgcgaatcacttggtcaaaagataacaaggagatccgtcctggaggaaactatacaatcacatgtgtgggaaacactcctcatttgagaattcttaaagtaggcaaaggagactctggtcaatatacttgccaagcaaccaatgatgttggcaaagacatgtgctcagctcagctcagtgtaaaagaacctccaaagtttgttaagaaattagaagcttcaaaagttgcaaagcagggagaatccattcaactggaatgtaaaataagtggctccccagaaatcaaagtttcatggttccgaaatgacagcgaacttcatgaaagttggaaatacaacatgtcattcattaattctgtggcattgcttacgatcaatgaagctagtgctgaagacagcggggactacatttgtgaggctcataatggtgttggtgacgccagctgcagcacagcgttgacagtgaaagcacctcctgttttcacccagaagccttctccagtaggagctcttaaaggttctgatgtgattctccaatgtgaaatttcgggaactcccccatttgaagtagtatgggttaaagatcgaaagcaagttagaaacagcaagaaatttaaaatcacttcaaaacattttgatacaagtcttcatatccttaatcttgaagcctccgatgtcggggaatatcactgcaaagctactaatgaggtgggaagtgacacgtgttcttgctctgtcaagttcaaagaacctccacgattcgtgaaaaagctaagtgacacctcaacccttattggggatgctgttgagttacgggccatagtggagggcttccagccaatttctgttgtctggctgaaagatagaggtgaagtcatcagagagagtgaaaataccaggatttcattcattgataacattgcaaccctccagctggggagtccagaagcatctaattctggaaaatatatatgccaaatcaaaaacgatgctggaatgagagaatgctctgcagtcttgactgtactagaaccagcaagaatcatagagaagcccgaacccatgactgtcactactggaaatccttttgcattagagtgtgtagtgactggaacaccagaactctcagccaagtggttcaaagatggaagagaattgtctgcagacagcaaacatcacattacattcatcaataaagtggcttcccttaaaatcccctgtgccgaaatgagtgacaaaggattatatagctttgaagtgaaaaacagtgttggcaaaagtaactgcactgtatccgtccatgtttctgatcggattgtgcctccttccttcatccgcaagctgaaagacgtgaatgccatcctgggggcctcagttgttttggagtgccgagtctctggctcagccccgatttcagttggctggtttcaggatggaaatgagattgttagtgggcccaaatgtcagtccagcttttcggaaaacgtctgtactttgaatctgagcttgttggagccctccgacacaggcatatacacgtgtgtggctgccaatgtagctggttccgatgagtgctcagcagtcctgactgtgcaagaaccaccatcttttgaacaaacccctgattctgtggaagttttgcctggaatgagcctcacattcaccagtgtcatcagaggcacccctcctttcaaggtcaagtggtttaaaggcagcagggaactggtgcctggggagtcatgcaacatctctctggaagattttgtcacagaactggagttgtttgaggtgcagccattagaaagtggagactattcttgcctcgttacaaatgatgctggcagtgcttcctgtaccacacatctttttgtgaaagaaccagccacctttgtgaaaagattggctgatttcagtgttgagacaggaagccccatagttctcgaggccacatacactggcacacctccaatctcagtgagctggataaaggacgagtatcttatttcacaatctgagagatgcagtattactatgacagaaaaatctaccatactggaaattcttgagagcacaatagaggattatgcacagtacagctgcctgatagaaaatgaggctggtcaagatatctgtgaagctctggtgtctgtcttagaaccaccgtactttattgaacctctggaacatgtggaagcagtcattggagaacctgcaactttacagtgtaaagtggatggaactccagaaattagaatttcttggtataaagaacacacaaagctacgatcagctcctgcatataaaatgcaattcaaaaataacgttgcttccttagtaatcaacaaagtggatcacagtgatgtgggagagtattcatgcaaggcagacaacagtgtgggggcagtcgcttcttcagctgtgcttgttatcaaagcgcgcaaacttccacctttctttgcaagaaaactgaaagacgttcatgagactctaggcttcccagttgcatttgaatgccgcatcaatggctcagaacctcttcaagtgtcttggtacaaggatggggttcttttgaaagatgatgctaatttgcagacatcttttgttcataatgtagcaactcttcagattttacaaactgaccagagccacatagggcagtataattgctctgcttctaatcctcttgggactgcttcatccagtgccaagctcattctctcagagcatgaagtgcctcctttctttgatctaaagcctgtatcagtagatcttgctcttggagaaagtggtacttttaaatgtcatgtaactgggactgcaccaatcaaaatcacttgggccaaagataaccgagagattcgccctggaggcaactacaagatgactttggtagaaaatactgccactctgacagttctcaaagtaggcaaaggcgatgccgggcagtacacctgctatgcaagcaacatcgctggaaaagactcttgttctgctcagctgggtgtacaagaaccacccaggttcattaagaagctagaaccttcaagaattgtgaaacaggatgaattcacaaggtatgaatgcaaaatcggtgggtctccagaaatcaaagttttatggtataaggacgagactgaaattcaagagagcagtaaattcagaatgtcattcgttgactcggtggctgtgctggaaatgcacaatctcagtgttgaagacagtggagactacacctgtgaggcccacaatgcagcaggcagtgccagcagcagcacatccttaaaagttaaagaaccacccattttccgcaaaaagcctcatcctatagagacactgaaaggagctgatgttcaccttgaatgtgagcttcagggcactcccccatttcacgtttcttggtataaagacaagagagaacttaggagcggcaagaagtacaagataatgtctgagaacttcctaaccagtatccacatcctgaatgtcgatgctgcagacattggggaatatcagtgtaaagccacaaatgatgtgggaagcgacacttgcgttggttccatcgctctcaaagcaccaccaagatttgtgaagaagctcagtgacatatctactgtcgttggtaaagaagttcagctgcagactaccattgaaggcgctgaacccatttcagtggtgtggttcaaagataagggagaaatcgttagagaaagtgacaacatatggatttcttattcagaaaacattgcaaccttacagttttcaagagtggaaccagccaatgctggaaaatacacttgtcagatcaaaaacgatgctgggatgcaagagtgcttcgccacgctatccgttctcgagcctgcaacaattgtagaaaagccagaatccataaaagttaccacgggagacacctgtaccttggagtgtacagtagctggcacccctgaactcagtactaagtggtttaaggatggaaaagagctaacaagtgacaacaaatacaaaataagcttcttcaacaaagtatctggccttaagatcatcaatgtagcaccgagtgacagtggggtatacagttttgaggtgcagaaccctgttggcaaagacagctgcacagcttcattgcaggtttcagaccgaaccgttcctccttcattcacaagaaaattgaaagagacaaatggtctatccggctcctcagttgtaatggagtgtaaagtctatgggtcacctccaatctctgtctcctggttccatgaaggaaatgagatcagtagtggaaggaaataccagaccaccctgacagataatacttgtgctttaactgtgaacatgctggaagaatcagacagtggtgactacacatgtatagctactaatatggctggttctgatgaatgtagtgctcctttgactgtgagagaaccaccatcttttgttcagaaacctgatcccatggatgttttaactgggaccaatgtaactttcacaagtatcgtaaaaggaacacctcctttcagtgttagctggttcaaaggtagcagtgaactagtaccaggtgacagatgcaacgtgtctttggaggattcagttgctgaactggagttgttcgatgtagatacatcacaaagtggagaatatacttgcatagttagcaatgaagctggcaaggcttcttgtacaacacatctctacataaaagccccagccaaatttgtgaagaggctgaatgattacagcatagagaaaggaaaacccctgatcctagagggtacattcactggaactcctcccatttcggttacctggaagaaaaatggcataaatgtaactccttctcagaggtgtaatataactacgactgaaaaatcggcaatcctggaaattccaagtagcacagtagaggatgcaggacaatacaactgctacattgaaaatgcctctggaaaagattcctgttcagcacaaatactcatactagaaccaccgtattttgtcaagcagttggagccggttaaggtgtctgttggagattctgcctctctacaatgccagcttgctggaacccctgaaattggggtatcctggtataaaggagatacaaaattgagacccactacgacttacaaaatgcattttaggaataatgttgctacactggttttcaaccaggttgatattaatgatagtggagaatatatctgcaaagctgaaaacagcgtgggagaagtttctgcatcaactttccttaccgttcaagagcaaaaacttccaccatcattttctcgacaattgagagatgttcaagaaacagttggactgccagttgtttttgattgtgccataagtggatcagaacctatctccgtgtcttggtataaagacggcaagccattgaaagacagcccaaatgtacaaacatcatttttagacaatacagccacactcaatatttttaaaactgaccggagccttgcaggccagtattcctgcacagctacaaaccctataggctctgcttcttccagtgccaggctcattctcacagaggggaagaacccacccttctttgacatccgtcttgcccctgtggatgctgtggtgggagaaagtgctgactttgagtgccacgtcacgggcacacaaccgataaaggtcagctgggccaaagacagcagagaaatacgaagtggcggaaagtaccagattagttatctggaaaacagcgcccacctgacagtcctcaaagtagacaaaggagattctggacaatatacctgctatgctgtgaatgaagtgggaaaagactcttgcacagctcagctgaatataaaagagcggctcatcccaccaagtttcactaaaagactctcagagacagtagaagaaacagaagggaattctttcaaacttgagggacgtgtggctggttcccaacctataactgttgcctggtacaaaaataatatagagatacaaccaacttctaactgtgaaataacattcaagaacaacacgttagtgctgcaagtcaggaaagcaggcatgaacgacgctggtttgtacacatgcaaagtgtccaatgatgcaggctctgctctgtgcacgtcttcaatcgtcatcaaagaacctaagaagccacctgtatttgatcagcaccttactccagtaacagtgagtgaaggagaatacgtgcagctcagctgccatgtccagggatctgagccaattaggatccagtggttgaaggctggcagggaaataaagccttcagacagatgcagcttcagctttgctagtgggacagctgtactggaactcagagatgtggctaaagcagattcgggagattatgtgtgtaaagcttcaaatgtggctggaagtgacactaccaaatcaaaagtgaccattaaagacaaaccagctgtggccccagcaaccaagaaagctgcggtagatggaagactcttttttgtgtcagaacctcagagtatcagagtcgtagaaaaaaccactgcgaccttcattgcaaaagttggaggtgacccaatcccaaatgttaaatggacaaaagggaagtggagacagctgaaccaaggaggtcgtgttttcatccaccaaaaaggcgatgaagcaaaactggagattagggacaccacaaaaactgattctgggttataccgatgcgtggcatttaacgaacatggtgaaattgaaagtaatgttaacttacaggtggatgaaaggaagaaacaagagaaaattgaaggcgatcttagagcaatgctgaaaaagactccaatcttaaagaaaggagctggagaagaagaggaaattgatatcatggaacttctcaaaaatgttgatcctaaagaatatgaaaaatatgcccgcatgtatggaatcactgacttccgaggtcttcttcaagcatttgaactgctcaagcaaagccaagaagaagagacacatagactggaaattgaggaaatagagaggtcagagagggacgaaaaggaatttgaggaacttgtatcatttattcagcaaagactgtcacagacagagcctgtcactctgatcaaggacattgaaaatcagacagttttgaaagataatgatgctgtctttgaaattgacattaaaattaattatccagaaatcaagctttcgtggtacaaaggaactgaaaaactggaacccagtgataaatttgaaataagcattgatggtgaccgacatacactcagagtcaaaaactgtcaacttaaagaccagggcaattatcgattggtttgtggtccacacatcgctagcgctaaactaactgtaattgagcctgcatgggaacggcatcttcaggatgtgactctgaaagaaggccagacttgcaccatgacatgccaattttctgtaccaaatgtaaaatctgaatggttcagaaatggcagaatccttaaaccccaaggtagacataaaacagaagtggaacacaaagtccataaattgaccattgcagatgttcgagcagaagaccagggtcagtacacctgcaaatatgaagaccttgaaacttcagcagaactcagaatcgaagctgaaccaattcagtttacaaagcgcatacagaacatcgtggtgagtgagcatcagtctgccacctttgagtgtgaagtgtcctttgatgatgccattgtaacatggtacaaaggaccaacagaactgacagagagccagaaatacaacttcaggaatgatggccgctgccattatatgaccatccacaatgtgaccccagacgatgaaggtgtctactcggtcatcgctcggctggagccaagaggtgaagcaagaagcacggcagagctgtacctaacgacgaaagaaatcaaacttgagctgaagcctcctgatattcctgactccagagttccaatcccaaccatgcctatcagagcagtgccaccagaagaaatccctcctgtggttgctcctcctatcccccttttgctaccaacacccgaagaaaagaaaccaccaccaaaacgtattgaagttaccaaaaaggctgtgaagaaagatgccaaaaaagttgttgcaaagcccaaagagatgacaccacgtgaagagattgtcaagaagcctccacctcctactaccttaattccagcaaaagctcctgaaatcattgatgtatcctctaaagctgaagaagtaaaaataatgactataaccagaaagaaagaggttcagaaagaaaaagaagctgtgtatgagaaaaagcaagcagtccacaaggagaagagagtcttcattgaatctttcgaagaaccttatgacgaactggaggtagaaccatacacagagccatttgaacaaccttattatgaagaaccagatgaagactatgaagagattaaggtagaagctaaaaaagaagttcacgaggaatgggaagaagattttgaagaagggcaagaatactatgaaagggaagaaggctatgacgaaggggaggaagagtgggaagaggcttaccaagaaagggaagtaattcaagttcaaaaggaggtctatgaagaatcacatgagagaaaagttccagccaaagtacctgaaaagaaagcaccaccacctcctaaagttataaagaagccagtaattgaaaaaattgaaaagacttctcgaagaatggaggaagaaaaagttcaagtcaccaaagtacctgaagtttcaaagaagattgttccacaaaaaccttcccggactccagtacaggaagaagttattgaagtgaaagtaccagctgtgcatacaaagaagatggttatttcagaagaaaagatgttctttgcttctcacacagaggaggaggtgtcagtcacagtccccgaggtacaaaaggaaattgttactgaagagaaaattcacgttgccatttccaaaagggttgaaccaccacctaaagtccctgagctacctgagaaaccagctccagaagaagtggcccctgttcctatccctaaaaaagtggagcccccagcaccaaaagttcctgaggttcccaagaaacccgtgccagaggagaaaaagccagttcctgtgcctaagaaggaacctgctgctcccccaaaagtcccagaggtgccaaagaaacctgtccctgaagaaaagattcccgttcctgttgcaaagaaaaaggaagctcccccagctaaagttcctgaagtacagaagggagttgtgacagaagaaaaaataaccattgtaactcaaagagaggaatctccaccaccagcagtgccagaaataccaaagaagaaagttcctgaagaaaggaaacctgttcctcggaaggaggaagaagttccaccaccaccaaaagtgccagctctgcctaagaaacccgtcccagaggagaaagttgcagtgccagttcctgtcgctaagaaagctcctcctccccgagctgaagtctctaagaaaactgttgtagaagaaaagagatttgttgctgaagaaaaactatccttcgcagttcctcaaagagtggaagtcacgcggcacgaagtatctgcagaggaggaatggagttactcagaagaggaggaaggtgtgtccatttcagtttatagagaagaagaaagagaggaggaggaagaagcagaggttacagaatatgaagtgatggaagagcctgaggaatatgttgtggaagaaaagctgcacattatttctaagagagtggaagctgagccagctgaagtgacagagaggcaggagaagaaaattgtactgaaaccaaaaattcctgctaaaatagaggagcctccaccggctaaagttcctgaagcacctaagaaaattgtgccagaaaagaaagttcctgctccagttcctaaaaaggaaaaggtgcccccacctaaagtgccagaagagccaaagaaaccagttccagaaaaaaaggttcctccaaaagtcattaagatggaagaacctctcccagccaaagtgactgagaggcacatgcaaattacccaggaagaaaaagttcttgttgctgtaactaaaaaagaggcgcctccaaaagcaagagtgccagaggaaccgaagagagctgtcccagaagaaaaagttctgaaactcaaacctaaaagagaggaggaaccaccagctaaagtgactgaattcagaaaaagagtggttaaagaagaaaaagtatcaattgaagctccaaaaagagaacctcaacccatcaaagaagtaactataatggaagagaaagaaagggcttataccctagaagaagaagctgtttcagtacaacgggaagaagaatatgaggaatatgaagaatatgattataaagaatttgaggagtatgaaccaacagaagaatatgaccaatatgaagaatacgaggagcgggagtatgaacgatatgaagagcatgaagaatacatcacagaaccagagaagcctatccctgtaaagcctgtcccagaagaaccagttcccacaaaaccaaaggccccaccggctaaagtgctgaagaaagctgtccctgaagaaaaagtaccagtgcccattcctaagaaactcaaacctccaccacccaaagtgcctgaagaaccaaagaaagtttttgaggaaaaaatacgtatttcaattaccaaacgtgaaaaagagcaggtgactgaacccgctgctaaagtgcccatgaagcccaagagggttgtcgcagaagaaaaagtacctgtccctagaaaagaagtagcaccacctgttagagtgccagaagtgcctaaagaacttgaaccagaagaggttgcctttgaagaggaagttgtaacccatgtagaagaatatcttgtagaagaagaagaagagtacattcatgaagaagaggagttcataactgaggaagaagtggtgccagtgataccagtcaaagtgcctgaggtacccaggaaacctgttccagaagagaagaaacctgttcctgttcccaagaagaaggaagctccaccggcaaaagtgcctgaggttcctaagaagccagaggagaaagttcctgtgcttattcctaaaaaggagaagcctccgccagcaaaagttcctgaagtgcccaagaaacctgtgccagaggagaaagtaccagtaccagttcctaaaaaggtggaagctccacctgccaaagtgccagaggtacccaagaagcctgtgcctgagaagaaggtgccagttcctgctcctaagaaagtggaggctccacctgcaaaagtgccagaggtgcccaagaagctcatcccagaagaaaagaaaccaacacctgttccgaaaaaagtggaagcaccaccacccaaagtgccaaagaaacgtgaaccagttccagttcctgtagctctacctcaggaagaggaagttctatttgaagaagaaattgttcctgaagaggaagttctacctgaggaagaggaagttctacctgaggaagaggaagttctacctgaagaagaggaagttctacctgaagaagaggaaattccacctgaggaagaggaagttcctcccgaagaagaatatgtacctgaggaagaagaatttgtacctgaagaagaagtccttccagaagttaaacctaaggtgccagtacctgcaccagtgcctgaagtgccaaagaaacctgtaccagagaagaaagtccctgttcccgcccctaaaaaagtggaacctccaccaccacccaaagtgcctgaaattaagaagaaagtgacagagaagaaagtggtcattcccaagaaagaggaggctccccctgccaaagttcctgaggtgcctaagaaggtggaagaaaaacgaatcattctccctaaagaagaggaagttctaccagttgaagtgactgaggagcctgaagaagagcctatttcagaagaagaaatcccagaagaaccacctagcatagaggaagttgaagaggtggcaccacctagagtgcctgaagtgattaagaaagcagtacctgaagcacctactcctgttcctaaaaaagtggaggcaccaccagctaaagtgtcaaagaaaattcctgaggaaaaagtacctgttcctgttcagaaaaaagaggcacccccagccaaagtgcctgaagtaccaaagaaagtcccagaaaagaaagtccttgtgcctaaaaaggaagctgttcccccagctaaagggagaactgtccttgaagaaaaagtatcagttgccttccgccaagaagtagtagtaaaagaaagactagaattagaagtagtagaagcagaagtggaagaaattccggaagaagaagagttccatgaagttgaagaatattttgaagaaggcgagtttcatgaagtagaagaattcatcaaattagaacaacatagagttgaagaagaacacagagttgaaaaagttcatagggtaatagaagtttttgaggctgaagaagtggaagtatttgaaaaaccaaaagctccacctaaagggcctgagatatctgagaaaatcatccctccaaaaaaaccgcccactaaagttgttcctcgaaaagagccaccagctaaagtaccggaggtgcctaagaaaattgtggtagaagaaaaagtacgtgttcctgaagagcccagagttccaccaactaaagcacccgaagtacccaagaaaattgtcccagaagaaaaagttcgtgaagctgttctgaaaaagcctgaagttccaccagctaaagtacttgtgactcaacctcaaaagacaaaacccaaactagcaaaagtgcctgagccacccaagaaagttgttccagaagacaaaatatatgtgactattcctaaaaagagagaaacaccagcaactaaagaacctgatacaaccagaggcatttttccagaggtggagccacctgaggctattcctgaaattccagaacatcctccaactgaagagtttgaagtcttcaaggaagtcattccagagggagaaactcctattgttaaaagaagaaaaacaccatcaccaacagcaccagaagctatgaaagaagttgtccctgaaatgaaaatatttgaggatgtacctgaagagccagaaactccacgtatgaaaacgcccgaagctcctcaagaaattattcctgccaagacagttccttccaaaaaaagagaacccccatcagttaaagtgcctgaagctctccaagaaattgtccctgaaaagaaaacgcttgtggttcctctcagaaagcctgaagtccttcctgatgaagtgccggaggctctcagagaagttgtcccggaaaagaaagtgcatcctccccaaagggctgaagttgtacctgtcaaagtgcacgaagctcccaaagagattatccctgaaaagaaagtgtcggtggtgcctcctaaaaagcctgaagtcccacctgttaaagtgccagaagcttccaaagaggttatccgcgaagagaaagtgcccttggctcctcctaaagagcctgaagtcccacctgttaaagtaccagagcctcccaaagaagtagttcctgaaaagaaagcgccagtggctcctcctaaagagcctgaagtcccacctgttaaagtgcctgaggctcccaaagaagttgttcctgaaaagaaagtgccagtgcctcctcctaaaaagcctgaagtgccacccacaaaagtcccagaggtgccaaaggcagctgtcccagaaaagaaggtgcctgaagctattcctcccaaaccggaaagtcctccccctgaagtgcctgaagtgctgccaccgaaggaagtggtcccagaaaagaaagtaccggtgcctcctgccaaaaagccagaagctccacctcctaaagttcctgaagctcctaaagaagttgtacttgaaaagaaagcatctgtggctgtgcccaaaaaaccggaagccccacgtgcaaaagtgcctgaagctgctcaagaagttgtcccagaaaagaaaattcccaaggcaccaatcaaaaaaccagaagcccccgcagttacagtgccagaagttcctcaagaagccgcagaaaaagaaattcccgtggctccacccaaaaaaccagaagctccaattgtcccagtgcctgaagtcccacaagaaattgtgccagaaaagaaaacactggtgcttcctaaaaagccagaagttccacctgttacagtgccagaggctcccaaagaagttgtccttgaaaagaaagtgcccttggctcctcctaaaaagcctgaagtcccacctgttaaagtgccagaggctcccaaagaagttgttcctgaaaagaaagtgccagtgactcctcctaaaaaacctgaagtcccacctgttaaagtgccagaggctcccatagaggttgttcctgaaaagaaaatgcccttggctcctcctaaaaagcctgaagtccctcctgttaaagtaccagaggctcccaaagaggttgttcctgaaaagaaagtgccctcggctcctcctaaaaagcctgaagtcccacctgttaaagtgccagaggctccgaaagaagttgttcctgaaaagaaagtgccagcggctcctcctaaaaagcctgaagtcacacctgttaaagtgcctgaggctcccaaagaagttgttcctgaaaagaaagtgccagtgcctcctcctaaaaagcctgaagtgccacccacaaaagtcccagaggtgccaaaggtagctgtcccagaaaagaaggtgcctgaagctattcctcccaaaccggaaagtcctccccctgaagtgttcgaggagcctgaggaagttgccctagaagagcctcctgctgaagttgtggaagagccagagccagcggcgcctccacaagtgaccgtaccacctaagaaacctgtcccagaaaagaaagcacctgctgtcgttgccaaaaaacctgaactaccaccagtgaaagtgcccgaggtgcccaaggaggttgttcctgaaaagaaggtgcctctggtggttcccaaaaagccagaagccccacctgctaaagtgcctgaagttccaaaagaagttgttccagaaaagaaagtagctgttcccaaaaagccagaagtcccaccagcaaaagtgccagaagtgccaaagaaacctgtcttggaagagaaaccagctgttcctgttccagaaagagcggagtctcctcccccagaagtatatgaagaacctgaggaaattgctcctgaagaggaaattgctcctgaagaggaaaagccagttcctgttgcagaagaggaggaaccagaggttccacctccagcagtgcctgaagagcccaagaagatcatcccagagaagaaagttcctgtcatcaaaaaaccagaagcaccgcctcctaaagaacgtgaaattgaaaagtatattaaacctgaagagcccgaacctgaaccacagcctgaagaaataccagtaaaagaacctgaacctgaaaaggttattgagaagccaaaactcaaaccaagacccccacctcctccacctgctccacctaaggaagatgtgaaggagaaaatattccaacttaaagctattccaaagaagaaagttcctgaaaaacctcaggttccagaaaaagtggagcttacacctctgaaagtgcctggaggtgaaaagaaagttcgcaaattacttccggaacgtaaacctgaaccaaaggaagaagttgttctgaaaagcgttctaagaaaaagacctgaagaagaagaacctaaagtagaacctaaaaaactagaaaaagttaaaaaacctgcagtaccagaaccaccacctccaaaacctgttgaagaggttgaagtacctactgttacaaaaagggaaaggaagattcctgaaccaacaaaagtgcctgaaatcaagccagcaatacctctccctgcacctgaaccgaaaccaaagcccgaagcagaagtgaaaacaatcaaaccacctcctgtggaacctgaaccaacccccatcgctgccccagtaacagtgccagtggttggaaagaaagcagaagccaaagcacctaaggaagaggctgccaagccaaaaggtcctatcaaaggtgtacccaaaaagactccttcaccaatagaagccgaaaggagaaagttaaggccaggaagtggtggagagaaacctcctgatgaagccccgttcacctaccagctaaaggctgtgccactgaagtttgtgaaagaaatcaaagacatcatcttgacagaatcagagttcgttggctcttcagcaatctttgaatgtttggtctccccttccactgcaattacaacctggatgaaagacggtagcaatatccgtgagagtcccaagcacaggtttattgcagatggtaaagacagaaagctgcacatcattgatgttcaactttccgatgctggtgaatacacctgtgttttacgtttgggaaacaaagaaaagacctccacggctaaacttgttgtagaagaacttcctgtgcgttttgtaaaaacactggaagaggaagtcacagtggtcaaaggacagccattgtacttgagctgcgagttaaacaaagagcgtgacgtggtctggaggaaggatggcaagattgtggtggagaaacctggccgaattgtgccaggcgtcattggcttgatgcgggctctgaccatcaacgatgcagatgacacagatgctggaacatacacagttactgtggaaaacgccaacaacctggagtgttcatcttgcgtaaaagtagtagaagtcattagagattggctggtgaaacctatacgagaccagcatgtgaaacccaaggggacagctatttttgcctgtgatatagcaaaagatactccaaacattaagtggttcaaaggatatgatgaaatccctgcggaaccaaatgataagactgaaatactgagagatggaaatcatctgtacctcaaaattaagaatgctatgccagaagatattgctgagtatgcagtggaaattgaaggaaaaagataccctgcaaagctgacacttggagagcgtgaagttgaactgcttaaaccaatagaggacgttaccatttatgagaaagaaagtgcaagctttgatgcagaaatctcagaggcagacattcctggacaatggaaactgaaaggagaacttctaaggccctcacctacttgtgaaatcaaagcagaaggtggaaaacgcttcttaactttgcacaaagtcaaactggaccaagctggtgaagtcctctaccaggcccttaatgcaattacaactgccattttgacagtaaaagaaatcgaacttgactttgctgtgcccctgaaggatgtcactgttccagaaaggcgacaggctcgattcgaatgtgtcctcacccgagaggcaaatgttatatggtccaaaggacctgatataattaagtcatctgacaaatttgatatcatcgctgatggaaagaaacatattcttgttattaatgattctcaatttgatgatgaaggggtctatactgctgaggtggagggcaagaagacctcagctcggttgtttgtcacaggtataagactgaaattcatgtcacctcttgaagatcaaacagtaaaagaaggtgaaacagcaacttttgtttgtgaactttctcatgaaaaaatgcatgtagtctggttcaaaaatgatgccaaactccatacaagcagaacagtactcatctcttctgagggcaagactcacaaattggaaatgaaagaagtgacattggatgatatatctcagataaaagctcaagtcaaggagctgagctccacagcacagctgaaggtcttagaggccgatccctacttcactgtgaaattacatgacaaaactgcagtggagaaggatgagattactttgaagtgtgaagtgagcaaagatgtaccagtgaaatggttcaaagatggtgaagagattgtcccttcacccaaatattctatcaaggcagatggcctgcgccgcatcttaaaaatcaaaaaggcggaccttaaagataaaggcgaatatgtgtgtgactgtggcacagacaagaccaaggcaaatgttactgttgaggctcgactaataaaagtggaaaagcctctgtacggagtagaggtgtttgttggtgaaacagcccactttgaaattgaactttctgaacctgatgttcacggccagtggaagctgaaaggacagcctttgacagcttcccctgactgtgaaatcattgaggatggaaagaagcatattctgatccttcataactgtcagctgggtatgacaggagaggtttccttccaggctgctaatgccaaatctgcagccaatctgaaagtgaaagaattgcctcttatcttcatcacacctctcagtgatgttaaagtcttcgagaaagatgaggctaagtttgagtgtgaagtatccagggagcccaaaacattccgttggctaaaaggaacccaggaaatcacaggtgatgacagatttgagcttataaaggatggcactaagcattcaatggtgatcaagtcagctgcttttgaagatgaagcaaaatacatgtttgaagctgaagataagcacacaagtggcaaactgatcattgaaggaatccggctcaaattcctcacccctctcaaagatgtaactgccaaagagaaggaaagtgctgtatttactgtggagttatctcatgataacatccgagttaaatggttcaagaatgaccagcgcctacacaccaccaggtcggtctcaatgcaagacgaagggaaaactcattcgatcacattcaaagacctgtctattgatgacacctcccaaattagagtagaagctatggggatgagttcagaagctaaactcactgtgcttgagggagacccatattttacaggaaaacttcaagattatactggtgtagagaaagatgaagttattctacagtgtgaaattagcaaagcagatgcaccagtgaaatggtttaaggatgggaaggaaataaagccatccaaaaatgctgttattaaggcagatggcaagaaacgcatgctaatcctaaagaaagccttgaaatcagatattggacagtacacctgtgactgtgggacagataagacctcaggaaaacttgacattgaggatcgggaaattaaactggtgcgacccctgcacagtgtggaggtgatggagactgagacagcacgctttgaaaccgaaatctctgaagatgatatccacgccaactggaaactcaagggagaggccctactccaaacacctgattgtgaaattaaggaagaaggcaaaatacactcccttgttttgcacaactgtcgcctggaccagacgggtggggtggatttccaagctgccaatgttaaatctagtgcccacctccgagttaagccacgagtaattggtcttctgaggcctttaaaggatgtcaccgtgactgcaggggaaacagccaccttcgactgcgagctctcctacgaagatatcccagtggaatggtatctcaaagggaagaaactagagcccagcgataaggtggtcccacgttcagaaggaaaagttcatacacttactctgagggatgtaaagttagaagatgctggggaagtccaactaacagcaaaagatttcaaaactcacgccaacctctttgtgaaagaacccccagttgaattcactaagcctcttgaggaccagacggtcgaagagggagccactgcagtgctggagtgtgaagtctccagagaaaatgctaaggtgaaatggttcaaaaatgggacagaaatcctcaaaagcaagaagtatgaaattgttgctgatggcagggtcagaaaacttgttatacatgactgtaccccagaggatattaaaacatacacttgtgatgctaaggattttaagacttcctgtaacctgaatgtcgtgcctcctcatgtggaattcttaagaccactcaccgaccttcaagttagagaaaaagaaatggctcgatttgagtgtgaactttcccgagaaaatgctaaggttaagtggtttaaagatggtgctgaaattaaaaagggcaaaaaatatgacatcatatccaagggagcagtgcgcattcttgtcatcaacaaatgtctactggatgatgaagctgaatattcctgtgaagtaaggacagcgagaacttctggcatgctgacagttctggaagaagaagctgtctttaccaaaaatcttgccaacattgaagttagtgaaacagacactataaaactggtttgtgaagtctccaaacctggcgcagaagtgatttggtataaaggggatgaggagatcattgaaacaggaagatatgaaatactgactgaaggacggaagagaatcctggtcattcagaacgctcaccttgaggatgctggcaactacaactgtcgactcccaagctctcgaaccgatggcaaagtcaaagtacatgaactggctgctgaatttatctcaaagcctcaaaaccttgaaatacttgaaggagaaaaggctgaatttgtctgctctatatcaaaagaaagctttccagtccagtggaagagggatgataagacacttgaatctggagataaatatgacgttattgctgatggtaaaaagagggtcctagttgtgaaagatgccacattacaagatatgggcacttacgttgtcatggtaggggccgccagagcagcagctcacttgacagtcattgaaaaactcaggatcgtagttcctcttaaggacacccgggtgaaggaacaacaggaagttgtcttcaactgtgaagtcaatactgaaggtgccaaagccaaatggttcagaaatgaagaagctatatttgatagttcaaaatacatcattctccaaaaagacctagtctacaccctcagaattagagatgcacacttagatgaccaagccaactataatgtgtctttgaccaatcacagaggtgaaaatgttaaaagtgcagccaatctaatagtagaagaggaagaccttaggattgttgagcctcttaaagatattgaaacaatggagaagaaatctgtcacattctggtgcaaggtgaatcgtctcaatgtaacactgaagtggaccaaaaatggtgaagaagtgccttttgacaaccgtgtctcatacagagttgataagtacaagcacatgttaaccattaaagactgtggcttcccagatgaaggtgaatacattgtcactgctggacaagataaatctgttgctgagcttctcatcatagaagccccgacagaatttgtggaacacttggaagatcagacagtcactgagttcgatgacgctgtcttctcctgccagctctccagagagaaagccaatgtaaaatggtacagaaatgggagagaaatcaaagaaggcaaaaaatacaaatttgaaaaagatggaagtatacacagactcattataaaagattgcaggctggatgatgagtgtgaatatgcttgcggggtagaagacaggaagtctcgtgctagactttttgtggaagaaattcctgttgagatcatcaggcctccacaagatattcttgaagcccctggtgctgatgttgtctttttagcagaactcaataaagataaggtggaagtccaatggctaagaaataacatggttgttgtccagggtgataaacaccagatgatgagtgaaggaaagatacatcgactacagatttgtgatattaagccccgtgaccagggtgaatacagatttattgccaaagacaaagaagccagagctaagcttgaactggcagctgcaccaaaaatcaagacagctgaccaagaccttgtggttgatgttggcaagcctctgacaatggtggtgccatatgatgcctaccccaaagcagaagctgaatggtttaaagaaaatgaacctttatctacaaaaaccattgatactacggctgaacaaacttctttcagaattttagaagccaagaaaggagacaaagggaggtataaaattgtgcttcagaacaaacatggaaaagcagaaggattcatcaatttaaaagttattgatgttcctgggccagtacgtaacttagaagtgacagaaacatttgatggtgaagtgagccttgcttgggaagaacctttaactgatggtggaagcaaaatcataggttacgttgttgaaagacgtgacattaagagaaagacctgggttctggccacagaccgtgcagagagttgtgagtttactgtcactggtctacagaaaggaggagttgagtacctattccgtgtgagtgcaagaaacagagttggcactggtgagccagtagaaactgacaatcctgtagaagcaaggagtaaatatgatgttccaggccctcctttgaatgtaaccatcactgatgtgaatcgatttggtgtctcactgacatgggaaccaccagagtatgatggaggtgctgagatcacaaactacgtcattgaattaagagacaagacttctatcaggtgggatactgccatgactgtgagagctgaagacctgtctgcaactgttactgatgtggtagaaggacaggagtacagtttccgagtgagagcccaaaatcgaattggagttggaaaaccaagtgcagccacacccttcgtcaaagttgctgatccaattgagagaccaagtcctcctgtaaacctaacttcctcagatcagactcagtcatcagttcagctcaaatgggaacctcctctgaaagatggaggaagcccaatattaggctatataattgagcgatgcgaagaaggaaaagataattggattcgttgcaatatgaaacttgtccctgaactgacttacaaggttaccggattggaaaaaggaaataaatatttatatagagtatctgcagaaaataaagctggtgtttcagatccatctgaaattcttggtcctctcaccgctgacgatgcatttgttgaaccaacaatggatttaagtgcatttaaagatggtctggaagttattgtcccaaatcctatcacgatcctggttccaagtacaggctatccaaggccaactgcaacctggtgttttggagataaagtactagaaacaggggaccgggtgaaaatgaagaccttgtctgcctatgccgaacttgtcatttctccaagtgaacgttcagacaagggcatttatacactgaaattagaaaaccgtgtgaaaacaatttctggggaaattgatgtcaatgtaattgctcgcccaagtgcacccaaagaattgaaatttggtgatataaccaaggactcagtacatttgacttgggaaccacctgatgatgatggaggaagtccgttaactggatacgttgttgaaaaacgagaagtcagccggaaaacatggactaaagttatggactttgtgactgatctagaattcacagttcctgatcttgttcaaggaaaagagtacttatttaaagtttgtgctcgtaacaaatgtggccctggagaacctgcatatgttgatgaacctgtaaatatgtcaactcctgcaacggtacctgacccaccagagaatgttaaatggagagatcgaacagccaatagcatcttcttaacatgggatccacctaaaaatgatggtggttcacgcatcaaaggatatatagttgaaagatgtccacgtggttctgataaatgggttgcctgtggagaacctgttgcagaaacaaaaatggaagtgacaggtcttgaggaaggcaaatggtatgcctaccgcgtgaaggccttaaacaggcagggtgctagcaaaccaagcagacccacagaggaaatccaggctgtggacacacaagaggccccagaaatcttcctcgatgtgaagctccttgctggtctcactgtaaaagctgggaccaagattgaacttcctgccaccgtaaccggaaaacctgaacctaaaataacttggacaaaggctgatatgattctgaagcaggacaaaagaattaccattgaaaatgtccctaagaaatccacagtgactattgttgatagtaagagaagtgacactggcacatatatcattgaggctgtgaatgtgtgtggccgggccactgctgtggtggaagtgaacgtcttagataaacccggaccaccagctgcctttgacatcacagatgtaaccaatgagtcatgtcttctaacatggaacccaccacgcgatgatggtggatctaagatcacaaactatgttgtggagagacgagcaactgatagtgaagtgtggcacaagctctcatccaccgtcaaggatacaaacttcaaggccaccaaattaatccccaataaagagtacatcttcagagttgctgcagaaaacatgtatggtgttggtgaaccagttcaggcctctccaataacagccaaatatcagtttgatccacctggtcctccaactcgcctagaaccttctgatatcactaaagacgcagtgactctcacatggtgtgagccagatgatgatggtggcagcccaatcacaggatactgggttgaaagactggatcctgatacagataaatgggttagatgcaataagatgccagtaaaggacacaacatacagagtgaaaggtctcactaataagaaaaaatacagattccgtgtgttggctgaaaatcttgctggacctggaaaaccaagcaaatcaactgaaccaatcttaataaaggatcccatagatcctccatggccccctggaaaaccaactgtaaaagatgtaggcaaaacatcagtaaggttgaattggacaaaaccagaacatgatggaggtgcaaagattgagtcttatgtcattgaaatgctgaagactggaacagatgagtgggtcagagtggcggaaggggttcccaccactcagcacttgctcccagggctcatggaaggacaggaatactcattccgagttagagctgtgaataaggctggggaaagtgaacccagtgaacccagtgaccctgtgctttgccgggagaagctatatcctccatcaccaccacgctggcttgaagttattaatatcacaaaaaatacagcagacctaaaatggacagttcctgagaaagatggagggtcccccatcaccaactacattgtggaaaagagagacgtcaggcgaaaaggctggcaaacagtggataccactgtcaaggacaccaagtgcacagtcaccccactgactgagggctctttatatgtgttccgagttgctgcagaaaatgctataggacaaagcgactacaccgaaattgaggactctgtgctggccaaagacacctttaccactcctggaccaccctacgccctggcagtggttgatgtgacaaaacgacatgttgacctaaagtgggagccacctaaaaatgatggtggaagaccaatacagagatatgtcattgagaagaaagaaaggttaggtacccgttgggtgaaagctggaaagactgcaggacctgactgtaacttcagagtaactgatgtcatcgaaggaacagaggtccagtttcaggttcgggctgaaaatgaagctggagttggccacccaagtgaacccacagaaatcctatccattgaagatccaacaagtcctccctcaccaccccttgacctacatgtgactgatgctgggagaaaacacattgccattgcttggaagcctccagagaaaaatggtggaagtcctatcataggataccatgttgaaatgtgtccagtaggcactgagaaatggatgagagttaattctcgcccaataaaggacttgaaattcaaggttgaagaaggtgttgttcctgacaaagaatatgtcctgagagtgagagcagtcaatgctattggtgtcagcgagccatctgaaatctctgaaaatgtggttgccaaagacccagactgcaagccaacaattgacctggagactcatgacattattgttattgaaggtgaaaagttaagcattcctgttcccttcagagctgtcccagttccaactgttagttggcataaagatggcaaagaagttaaagcaagtgatagattaacaatgaagaatgatcacatctctgcacaccttgaagttcccaagagtgtccgtgcagatgccggaatttataccattacactggagaataagctcggctcagcaacagcctcaatcaatgtcaaagtcataggcctacctggaccatgcaaagatattaaagcaagtgacattaccaagagttcttgtaagttaacttgggaacctccagaatttgatggtggaaccccaattcttcattatgtcctggagcgcagagaagctgggaggagaacatatataccagtcatgtctggtgagaacaaactgtcatggactgtgaaggatctcataccaaatggtgaatacttcttccgtgttaaagcagtcaacaaggttggtggaggagaatatattgaactgaaaaatccagtcattgctcaagatccaaagcaaccccctgatccacctgtagatgtagaggttcataatcctacagcggaggcaatgactattacatggaagccacctttgtatgatggagggagcaagataatgggctacatcatagagaagattgctaagggtgaagaaaggtggaagagatgcaatgaacacctggtaccaatcctgacctatacagcaaaaggacttgaagaggggaaagagtaccaattccgtgtgcgagcagagaacgccgcgggtattagtgaaccttctcgggctactcctccaaccaaagctgtagatcccattgatgcccccaaagtcattctgagaacaagcctagaagtgaaacgaggtgatgaaatagcacttgatgcaagtatttctggatcaccttacccaactattacatggataaaggatgaaaatgttattgtaccagaggaaattaagaagcgtgcagcacccttggttaggagaaggaagggtgaagttcaagaagaagaaccatttgtcctgcctctgacacagcgtttgagtattgacaacagcaaaaagggagaatctcagctacgcgtccgagattctctccgacctgaccatggtctgtatatgatcaaagttgaaaatgaccacggtattgcaaaagctccttgtactgtcagtgtgttagatacaccgggaccaccaatcaactttgtatttgaagatatcagaaagacctcagtcctttgtaaatgggaaccaccccttgatgatggtggcagtgaaatcataaactacactttggaaaagaaagacaagacaaaacccgactcagaatggattgttgtcacttcaacacttagacattgcaaatattcagtaacaaaactgattgaaggaaaagagtacctcttccgtgtaagagctgaaaacagatttgggccaggtccaccatgtgtttcaaagccacttgtggctaaagatccatttggaccacctgatgcaccagataagcccattgtggaagatgttaccagcaacagtatgctagtgaaatggaatgaaccaaaagataatggaagccccattttgggttactggcttgaaaaacgtgaagttaacagtacacattggtctcgtgtcaacaaaagccttctgaatgccttgaaagccaatgtagatggcttattagaaggactcacctatgtcttcagagtatgtgctgaaaatgcagctggacctggaaagttcagtccaccttcagatcccaaaacagcacatgatccaatctctcctcctgggccacctatcccaagagtcactgacacaagctctacaactattgaactagaatgggaacccccagctttcaatggtggtggggaaattgttggctattttgttgataagcagttggttggcacaaatgaatggtcacgctgcacagagaagatgatcaaggtccgtcagtacaccgtcaaagaaatccgagagggtgctgattacaaacttcgggtgagtgctgtcaatgccgcaggggaaggaccgcctggagaaacacaacctgttactgtggctgaaccacaagagcctccagctgtggaactggatgtttctgtcaagggtggaatacaaataatggctgggaagactcttagaattccagctgtggtgactggtcgccctgtacctacaaaagtatggaccaaagaagaaggggagctggataaagaccgtgttgtaatagacaacgttggaaccaaatctgaactaattatcaaggatgcactgcgaaaagaccatggcagatatgtgattacagctacaaatagctgtggttccaaatttgcagcagccagggtagaagtttttgatgtccctggtccagttcttgacttaaaacctgttgtaacaaacagaaaaatgtgtctacttaactggtctgatccagaagatgatggaggaagtgaaataacaggctttatcattgaaagaaaagatgccaagatgcatacttggagacaaccaatagagactgagagatctaaatgtgacatcacaggtctgcttgagggacaagaatataagttccgtgttattgccaagaacaagtttggctgtggccctcctgttgaaataggaccaattcttgcagttgatccactaggtcctccaacatctccagagaggctcacatacactgaaaggacaaagtccactatcacacttgactggaaagagccccgcagtaatggtggcagtcccatccaaggatatatcattgaaaaacggcgtcatgacaaacctgactttgaaagagttaacaagcgactctgcccaaccacatcttttctggttgaaaatcttgatgaacaccaaatgtatgagttccgtgtcaaagctgtcaatgaaattggtgaaagtgaaccatccctacctcttaatgtagtcatacaagatgatgaagtgcctccaactattaagttgcgtctgagtgttcgaggagacactatcaaagttaaggcaggagagcctgtccacatccctgcagatgtgacaggccttccaatgcctaagattgaatggtccaaaaatgaaactgtaattgaaaaacccactgatgcacttcagataaccaaggaagaggtatcccgaagtgaggcaaaaactgagcttagcattcccaaagcggtccgggaggacaaaggcacttacacagttactgcttccaatcgccttggctcagtgttccgaaatgttcacgttgaagtatatgaccgcccatccccaccaagaaatcttgctgttactgacattaaagctgaatcttgctacttgacatgggatgcccctcttgataatggtggcagtgaaatcacccattatgttattgacaaacgtgatgcaagtaggaagaaagcagaatgggaggaagtcaccaacactgctgtagagaaaagatatgggatctggaaacttatccccaatggtcagtatgagttccgagtcagggcagtgaataaatatggaatcagtgatgagtgcaaatcagataaagtagtcattcaagatccttatcgccttcctggacctccaggaaaaccaaaagttttggcacgcaccaaaggatcaatgctagtgagctggactcctcctttggacaatggtggctctccaattactggctactggctggagaaaagagaagagggaagtccttattggtcacgtgttagccgagcaccaataaccaaagtgggattgaaaggcgtggaatttaatgttcctcgtttgcttgaaggcgttaaataccagttcagagccatggcaataaatgctgcaggaattggtcctcccagtgaaccatcagatccagaggttgcaggagatcccatatttccaccggggccaccttcttgcccagaagttaaagataaaacgaagtcaagcatctcactaggatggaaacctccagccaaagatggtggcagcccaatcaaaggatacattgtagaaatgcaagaagaaggtactactgactggaaaagagtaaatgaaccagacaaacttataactacctgtgaatgtgtggtgcctaatctgaaagagctcaggaagtacagattcagagtgaaagctgtcaatgaagctggtgaatctgaaccaagtgatacaactggggagatccctgccactgatattcaagaggaaccagaagttttcattgacattggagcacaggactgtctggtttgtaaagctggctcacagattaggattcctgctgtcatcaagggacgcccaacaccaaaatcatcttgggaatttgatggaaaggcaaagaaagcaatgaaggatggagttcatgacatacccgaagatgcacagctggagactgctgaaaactcctcagtaattattattccggagtgtaaacgatctcatacaggcaaatacagcatcacagccaagaataaagcaggacaaaagactgcaaattgcagagttaaagtcatggatgtaccaggcccacccaaagatctgaaagtcagtgatatcacaaggggtagttgcagactttcatggaagatgccagacgacgatggaggagacaggatcaaaggctatgttattgagaagaggactattgatggaaaagcctggaccaaagtcaatccagactgtggaagcaccacatttgtagtgcctgatctcctctctgaacagcaatatttcttccgtgtgcgagcagaaaaccgttttggtattggcccacctgtggaaaccattcagaggaccactgccagagatccgatatatcctcctgatcctcctattaaactcaagattggcctcatcacaaagaacacagtgcatctgtcatggaaacccccgaagaatgatgggggctcccctgttacccactatattgttgagtgccttgcatgggaccctactgggacaaagaaagaagcctggaggcagtgcaataagcgtgatgtggaagaactgcaatttactgttgaagacctagtagagggtggggaatatgaattccgagtcaaagctgtcaatgctgcaggagtcagcaagccttcagccactgttggccctgtgactgtcaaagaccagacatgcccaccatcaattgatctaaaagaattcatggaggttgaagaaggaaccaatgttaacattgtggccaaaattaaaggtgtgccattcccgacactaacctggtttaaagctcctccaaagaagcctgataacaaagaacctgttctctatgacacccatgtcaacaaactggtggtagatgatacttgcactttagttattccgcagtctcgcaggagtgacactggcttatataccatcacagctgtaaataatctgggaacagcatcaaaggagatgagactgaatgtcctgggtcgtcctggccctccagtgggacccataaaatttgaatctgtttcagcagatcaaatgacactatcttggtttccacctaaagatgatggtgggtctaagattacaaactatgtaattgagaaaagagaagctaacaggaagacatgggtccatgtctccagtgaacctaaggagtgcacgtacacgattcccaaattgctagaaggccatgaatatgtattccgaatcatggcccagaataaatatggcattggagaacctcttgacagtgaacctgaaacagcaagaaacctcttctctgtccctggagcaccagataaaccaacagttagcagcgtgactcgtaactccatgactgtcaactgggaagagccagaatatgatggaggctctcctgtgacagggtactggctggaaatgaaagacaccacttcaaagagatggaagagagttaaccgagatcctatcaaagccatgactttgggtgtttcttataaagtgactggtcttattgaaggttccgactatcaattccgggtatatgcaatcaatgctgctggcgtgggtccagcaagtctgccatcagacccagcgactgctagagatccaattgcccctcctggtcctccatttcccaaagtgacagattggactaaatcatctgcagatctggagtggtctcccccactaaaagatggtggatccaaagtaactggatacatcgttgaatataaagaagaaggaaaagaagaatgggaaaagggtaaagataaagaagtgagaggaacaaagcttgttgtgacaggattaaaggaaggagcattctacaaatttagagttagagcagtcaacattgctggcattggagaacctggagaggtcacagatgtcattgaaatgaaggacagacttgtttcacctgaccttcagctagatgccagtgtcagagatagaattgttgtccatgctggaggggtgatccgaatcattgcctatgtgtctggaaagcctcctccaaccgtcacctggaacatgaatgaaagaaccttacctcaagaagccaccattgagaccacagccattagctcatccatggtcatcaagaactgccagaggagccatcaaggcgtctattctcttcttgccaaaaatgaagccggagaaagaaagaagacaattattgttgatgtattagatgttccaggtcccgttggaacaccattcctagctcacaacctaaccaatgagtcctgcaaactgacatggttttctccagaagatgatggaggctctccaatcaccaattatgtcattgaaaagcgtgaatctgaccgcagagcatggaccccagtgacatatacagttacccgacaaaatgctactgtccagggtctcattcaaggaaaagcctactttttccgaattgcggctgaaaatagtattggcatgggtccatttgttgagacatcagaggcacttgttatcagagagccaataactgtaccagagcgtcctgaagacctggaagtcaaagaagttactaaaaatactgtaactttgacttggaatcctcctaagtatgatggtgggtcagaaattattaactatgtcctagaaagtcggctcattgggactgagaagttccacaaagttacaaatgacaacttgcttagcagaaaatacactgttaaaggcttaaaagaaggtgatacctatgagtaccgtgtcagtgctgtcaacattgttggacaaggcaaaccatcattttgcaccaaaccaattacttgcaaggatgagctggcacccccaacgcttcacctcgacttcagagataagctcacgattcgagttggtgaagcttttgccctcactggccgttactcaggcaaaccaaagcctaaggtttcctggttcaaagatgaagctgatgtgctggaagatgatcgcactcatataaagactacaccagcaacacttgctttagagaagatcaaggccaaacgttcagattccggcaaatactgtgtggttgtggagaacagtacaggctctaggaaaggtttctgtcaagttaatgttgttgaccgtcctggaccaccagtaggaccagttagttttgatgaggtgaccaaagattacatggttatctcttggaagcctcctttagatgatggaggcagtaaaatcaccaattatattattgagaagaaggaagtgggtaaagacgtctggatgccagtgacatctgcaagtgctaaaacaacatgcaaagtttctaaactacttgaaggaaaagattatattttccggatacatgctgaaaatctgtatggaataagtgatcctctggtgtctgattcaatgaaagccaaagatcgtttcagggttcctgatgcacctgatcagccaattgttacagaagttaccaaagactctgcattagtaacctggaataagccacatgatggaggaaaacccatcacaaactacatcctggaaaagagagaaactatgtctaaacgatgggctagagttaccaaagatcctattcatccatacactaaatttagggttcctgatcttctagaaggatgtcagtatgaattccgggtttctgcagaaaatgaaattggtattggagatccaagcccaccatccaaaccagtctttgctaaagatccaattgctaaaccaagtccacctgttaatcctgaagcaatagatacaacatgcaattcagtcgatctaacttggcagccaccacgtcatgatggtgggagcaagattctgggttatattgttgagtaccagaaagttggagatgaagagtggagaagagccaatcacacccctgagtcatgtcctgaaactaaatataaagtcaccggtcttcgggacggtcaaacctataagtttagagtgttagcagtcaatgcagctggtgaatcagatccagctcatgttccggagccagtcctagtaaaagacaggcttgaaccccctgagttgattcttgatgccaacatggcaagagaacaacacattaaagttggtgatactctaagacttagtgccatcatcaaaggagtgccattcccaaaagtaacttggaaaaaagaagacagagatgctccaactaaagcaagaattgatgtgactccagttggtagcaagcttgaaattcgtaatgctgcccatgaagatggtggaatttattctttaacagtggagaatccagctggttcaaaaactgtctcagtaaaagtacttgtattagataaacctgggccacctagagatctggaagtcagtgaaattaggaaagattcatgttaccttacttggaaagaaccactggatgatggtggttctgttattaccaattatgtggttgagaggagagatgttgccagcgcccagtggtcacctctctcagctacatcaaagaaaaagagtcacttcgctaagcatctgaatgaaggcaaccagtacctcttccgagtagctgcggagaaccagtatggacgtggtccttttgttgaaacaccaaaaccaatcaaggctttggatcctctccatcccccagggccacccaaggacctgcaccatgtagatgttgacaagactgaagtctccctagtctggaataagccggatcgtgatggtggttctccaatcactggatatttggtagaatatcaagaagaaggcacccaggactggattaaatttaagactgtgacaaacttagagtgtgtggttactggactacaacaaggaaagacctatagattccgtgtaaaagctgaaaacattgtgggtcttggtctccctgacacaactatcccgatagaatgtcaagaaaaactagtgcctccatccgtggagctagatgtgaaattaattgaaggtcttgtggtaaaggctggaaccacagtcagattccctgctattataagaggtgtgcctgttcctactgcaaagtggacaaccgatgggagtgagattaaaaccgatgagcactacacagttgaaacagacaacttctcatcagtacttaccattaagaactgcttaaggagagacactggggaatatcaaatcacagtttccaatgcagccggtagcaaaacagtagccgtacatcttactgttcttgatgttcctgggccaccaacaggtcctattaatattctggatgttactcctgaacacatgactatctcatggcagccacctaaggatgatggaggaagccctgtgataaattatattgttgagaaacaagatacaaggaaagacacgtggggtgttgtctcttccggaagcagtaagacaaagctgaaaatcccacatctgcagaagggctgtgaatatgttttccgagttagagcagagaataagataggtgttggtcctccccttgactccacacctactgttgctaagcataaatttagtcctccgtctcctcctggtaaaccagtggttactgacattactgaaaatgcagcaacagtgtcttggaccctgccaaaatctgatggtggcagtccaataactggctactatatggaacgtcgagaagtaactggcaaatgggtgagggtcaacaaaacacctatcgctgacctgaagttcagagtgactggactctatgaaggaaatacatatgagtttagagtttttgctgaaaatcttgcaggactaagcaaaccatccccaagttctgatccaataaaagcttgccggcccatcaaaccacctggaccacctattaatcctaaactgaaagacaagagcagagaaacagctgatttggtgtggacaaagcctctcagtgatggtggtagccccattctaggatatgtagtggaatgtcagaaacctggcacggcacaatggaacaggattaataaagatgaactcattaggcaatgtgcctttagggtacctggactaattgaaggaaatgagtacagattccgtataaaggcagctaatattgtaggagagggtgagccaagagaactagcagaatctgtgattgcaaaagatatccttcatcctccagaagtagaacttgatgttacttgtcgtgatgttattaccgtgagagtaggccaaactatccgcattctagctcgagtcaaaggcagacctgaaccagacataacttggactaaggaaggcaaagtattggtccgagaaaagagggtggaccttattcaggatctacctcgtgttgagttacaaattaaagaagctgttagagctgatcatggcaagtatatcatctcagctaagaacagcagtggacatgcccaaggttcagccatcgttaacgtccttgacagacctgggccttgccagaatttgaaggttaccaatgtaaccaaagagaactgtacaatttcttgggaaaacccactagataatggtggctcagaaataacaaacttcatagtagaatatcgcaaaccaaaccagaaaggctggtcaattgttgcatcagatgtcactaaacgattaatcaaggccaaccttttagccaacaatgaatactatttccgagtttgtgcagagaataaagtaggtgttgggccaaccatcgaaacaaaaactcccattctggctattaaccctattgacagaccaggtgagcctgaaaaccttcacattgcagataaaggaaagacatttgtctatctaaagtggcggaggcctgactatgatggtggcagtccaaatctgtcatatcatgttgagagaaggcttaagggctccgatgactgggaaagagtgcataaaggaagcattaaagaaactcactacatggttgacagatgtgttgaaaaccagatttatgagttcagagtgcaaacaaagaatgaaggtggggaaagtgactgggtgaagacagaggaagttgttgtgaaagaagacttacaaaaaccagtacttgatctgaaattaagtggggtcctaactgtcaaagcaggggacaccattaggcttgaggcaggggttagaggcaaaccattcccagaagttgcatggaccaaggacaaagacgctacagacttaacaagatcaccaagggtcaagattgatacccgtgctgattcatctaaattttctcttactaaagcaaagcgaagtgatgggggtaaatatgtagttacggcaactaacacggctggcagttttgtggcctatgccactgtcaatgttttagataagcctggtcctgtgagaaatctgaaaattgttgatgtgtccagtgataggtgtactgtttgctgggatccaccagaagatgatggtggctgtgaaatccaaaattatattctagaaaaatgtgagacaaagcgaatggtttggtctacctattctgctactgtcttgacacctggtactacagtaacacgtctcatagaaggaaatgaatatattttcagagtccgtgcagaaaataaaataggcacagggcctccaacagaaagtaaaccagtcatagccaaaaccaagtatgataaacctggtcgccctgatcccccagaagtcactaaagtaagcaaagaagagatgactgtggtttggaatccacctgaatatgatggtggaaagtctataactggatactttttggagaaaaaggaaaagcattcaacacgatgggtccctgtcaacaagagtgcaatccctgagagacgtatgaaagtacagaatctcctcccagaccatgaatatcagttccgtgtcaaggcagaaaatgaaattggaattggagaaccaagcttgccttcaagaccggtggtggcaaaagaccccatagagccacctggtccaccaaccaatttcagagtggttgatacaaccaaacattccataactcttgggtggggaaaaccagtctatgatggtggtgcaccgatcattggatatgttgtggaaatgagaccaaaaatagcagatgcgtctcctgatgaaggctggaaacggtgtaatgctgcagcacagcttgtacgcaaggaattcactgttaccagcttggatgaaaaccaggaatatgagttcagggtgtgtgcccaaaaccaagttggtattgggcgccctgcagagctaaaggaagctatcaaacctaaagaaatactagaacctccggagattgatttggatgccagcatgaggaaactggtcatagtgagagcaggatgccctattcgtctctttgctatagtgagaggacgaccagcccctaaagtcacttggcgaaaagttggcattgataatgtggtcagaaaaggacaagttgatctggttgacactatggccttccttgtcatccccaattctacccgtgatgactcaggaaaatattccttaacacttgtgaacccagcaggagaaaaggctgtattcgtaaatgtcagagtattagacactcctgggcctgtgtctgatttaaaagtttcagatgtcactaaaacatcatgccatgtgtcctgggcccctcctgaaaacgacggtgggagccaagtgacacattatatcgtggagaaacgtgaggcagacagaaagacatggtcgaccgttaccccagaagttaagaaaacaagcttccatgtaaccaatcttgtccctgggaatgagtattacttcagagtaactgctgtcaacgaatatggccctggcgtcccaacagatgtcccaaaaccagtgcttgcatcagatcctctaagtgagccggatcccccaaggaaattagaagtgactgaaatgaccaagaacagtgccaccttagcctggttacctcccctacgtgatggaggtgctaaaatcgatggctacatcactagttacagagaagaagagcagcctgcagatcgctggacagagtactcagtggtaaaagatctgagccttgttgtcactggcctaaaggaaggaaagaaatacaaatttagagtagcggccagaaatgctgttggagtcagtttgccaagagaagctgaaggagtgtatgaagccaaagaacaactgttgccaccaaagatccttatgccagagcaaataactatcaaagctgggaaaaaactccgaattgaagcccatgtgtatggaaagcctcatcccacctgtaaatggaaaaaaggagaagatgaagttgtcacatccagccacctggcagtgcataaagcagacagctcttcaattctgatcataaaagatgtgactaggaaagacagtggttactacagcctcacagcagagaacagttctgggacagacactcagaaaatcaaagttgtagtcatggatgcccccggcccccctcagcctccatttgacatttctgatatagacgctgatgcttgctccctgtcatggcacatccctctggaggacggaggcagtaacatcaccaattatatagtggagaagtgtgatgtaagccgaggtgactgggtcacggctctagcttcagtcacaaaaacttcctgcagggttggaaagctgatcccaggccaggagtacatcttccgggtccgtgctgaaaaccgatttggcatttcagagcctctcacatctccaaagatggttgcgcagttcccatttggtgttcctagtgaaccaaagaatgcacgagtcaccaaagtcaacaaggactgtatttttgttgcttgggacagaccagatagtgatggagggagccccattattggttatctgattgaacgcaaggaaagaaacagtttgctgtgggtgaaagccaatgatactcttgtccggtcaactgaatatccttgtgctggccttgtagaaggtcttgagtattcattcagaatctatgccctaaacaaagctggatccagcccacccagcaaacccacagaatatgtaactgcaagaatgccagttgatcctcctgggaaacctgaggttattgatgtcaccaagagtactgtatctctgatctgggctcgtccaaagcatgatggaggcagtaaaattattggctatttcgtagaagcttgcaaacttcctggtgataaatgggtacggtgcaatactgcacctcaccagattccccaggaagagtacacagctactggcctagaagagaaagctcagtatcaatttagagctattgccaggaccgcggtaaacattagcccaccttctgaaccttctgatccagtgactatcctcgcagaaaatgtccctcccaggatagacctgagtgtggctatgaaatctttgcttactgtgaaagctggaactaatgtctgcttggatgctactgtttttggtaaaccgatgccaacagtttcttggaaaaaagatggcacactgctaaaaccagcagaaggcataaagatggccatgcagcggaatctgtgcaccttggagctattcagcgtgaaccggaaggactcaggagactataccattactgctgaaaattcaagtggttctaaatcagccaccattaagcttaaagtgttagataaaccgggtcctccagcatctgttaaaatcaacaaaatgtattcagatcgtgctatgctttcttgggaaccgcctcttgaagatggaggctcagaaatcaccaactatattgttgacaaacgtgaaacaagcaggcccaactgggctcaagtctctgcaactgtgcctatcaccagctgcagcgtggagaaacttatagagggccatgagtatcagttccgtatttgtgctgaaaataaatatggagtaggcgatccagtcttcactgaaccagcaattgccaaaaacccatatgacccaccaggacgctgtgatcctcctgttattagcaacataaccaaagatcacatgacagtcagctggaagccaccagcagatgatgggggctcacccatcactggctatttgcttgaaaagcgggaaacccaggctgttaactggactaaggtcaacagaaaacctattatagaaagaacattaaaagcaacaggtcttcaagaaggtaccgaatatgagttccgtgttacagctataaataaagctggaccaggcaaacccagtgacgcatccaaggccgcttatgctcgggaccctcagtatcctcctggcccaccggctttccctaaagtatatgatacaactcgcagctctgtgagtctatcttggggcaagccagcctatgacggcggcagccctatcattggttatctcgttgaagtaaaacgggctgactccgataactgggtgaggtgcaacttaccacagaatctacagaaaacccgctttgaggttactggcctgatggaagacacacaatatcaattccgtgtgtatgccgttaataagattggatacagtgaccccagtgatgtgccagataaacactatcccaaggacatcttaattccacctgagggagaacttgatgcggacttaaggaagacactcatattacgtgctggagttactatgagactatatgtaccagtaaaaggacgcccacctccaaagattacttggtctaaaccaaatgtcaatctaagagacaggattggactggacataaagtcaactgactttgacactttcttgcgctgtgaaaatgtgaacaaatatgatgcaggaaaatatatcttaaccctggagaacagctgtggtaaaaaggaatataccattgttgtgaaagtgcttgatactcctgggccacctgtcaatgtgactgttaaggaaatatccaaagactctgcttatgttacctgggagcctcccattattgatggcggaagccccatcataaactatgtggtacaaaaacgtgatgcagagaggaaatcctggtctacagtgacaactgagtgctccaaaacaagcttcagagtacctaatttggaggagggaaaatcctacttcttccgagtgtttgctgaaaatgagtatggcattggtgatcccggtgaaactcgtgatgctgtcaaagcttcccaaactcctggaccagttgtggacctgaaagtgaggtctgtatctaagtcatcctgtagcattggctggaaaaagcctcacagtgatggtggaagtcggattattggatatgtagttgatttcctgactgaagaaaataagtggcaacgagttatgaaatccttaagcctacagtactctgcaaaagatttgactgaagggaaggaatataccttcagagtgagtgctgagaatgaaaatggagaaggaaccccaagcgaaatcactgttgtggcaagggatgatgttgtggctcctgatcttgacttaaagggtctacctgatttgtgctacttggctaaagaaaacagcaacttccggcttaagatccccataaaaggcaagccagctccatcagtctcctggaagaaaggggaagatcctctagcaactgacactagagtcagtgttgagtcatctgcggttaacacaactcttatagtgtacgattgccaaaaatctgatgctggaaaatacacaatcacacttaagaatgttgctggcaccaaggaaggaactatctccataaaggttgttggcaagcctggcatccccactggaccaatcaaatttgatgaagtcacagcagaagccatgaccttaaagtgggctcctccaaaggatgatggaggttctgaaatcaccaactatatcctagagaagagggattctgtgaacaacaagtgggtgacgtgcgcctcagctgtccagaaaaccacctttagagtaaccagacttcatgagggcatggaatataccttcagggtcagtgccgaaaataaatatggtgtaggggaaggcctgaaatcggagccaattgttgcgagacatccatttgatgtgcctgatgctcccccacctcccaatattgtggatgtcagacacgattcagtatctctaacttggactgaccccaagaaaactggtggttctccaattacagggtatcatctcgagttcaaggaaagaaacagccttttgtggaagagagctaacaagactccgataaggatgagagactttaaagtgacaggattaactgaaggtcttgaatatgaattccgagttatggcaatcaatttagcaggtgtgggcaagccaagcctaccatcagagcctgttgtggcactggacccaattgatcctcctggaaaacctgaggttattaacataacaaggaattcagtgactctcatttggactgaacctaaatatgacggtggtcataagttaactggatatatagtggagaagcgagatctaccttcgaagtcttggatgaaagccaaccatgttaatgtcccagaatgtgcctttactgtaactgaccttgttgagggtggaaaatatgaattcagaattagagcaaagaatacagcaggtgctatcagtgctccatcagaaagtacagaaaccattatttgcaaggatgaatacgaggcaccaacaattgtccttgatcccacaataaaagatgggctaacaattaaagcaggggataccattgttttgaatgccattagcattcttggcaaaccccttccaaaatcaagttggtccaaggcaggaaaagacattagaccatcagatatcactcagataacttcaaccccaacatcttccatgcttactatcaagtatgccactagaaaagatgcgggtgaatataccatcactgctaccaatccttttggcacgaaggtggaacatgtgaaggtaacagtccttgatgtacctggtcccccaggtcctgttgaaatcagtaatgtttctgctgaaaaagcaacacttacatggacacctcccttggaagatggcggctcaccaattaagtcctatatacttgaaaagagagaaaccagccgacttttgtggacagtggtttctgaagatattcagtcttgcaggcatgtggcaaccaaacttatccaaggaaatgagtacatcttccgggtctcagctgtaaaccactatggcaaaggagaacctgtacagtctgaacctgtcaaaatggtagacagatttggtccccctggccctcctgaaaaaccagaggtatcaaatgtcactaagaacactgccactgtcagctggaaaaggccagtggatgatggtggcagcgaaattacaggatatcatgtagaaaggagagaaaagaaaagcctgcgatgggtgagagcaataaaaacaccagtttccgatctcaggtgcaaagtaacaggactgcaagaaggaagcacctacgaattccgtgtcagtgcagaaaacagagcaggaattggtccacccagtgaggcttcagattctgttctgatgaaagatgcagcatatcctccaggaccaccttcaaatccgcatgtcactgatactaccaagaaatctgcttctttggcatggggcaagcctcattatgatggtggacttgaaatcactggctatgtcgtggagcatcaaaaagtaggagacgaggcctggataaaagataccacaggaaccgccctcagaatcactcagttcgttgttcctgatcttcagactaaagaaaaatacaacttcagaatcagtgccatcaacgatgcaggtgttggggagccagcggtgattccagatgttgaaatcgtagaacgggagatggctcctgattttgaactagatgccgagcttcgaagaacacttgttgttagagcaggactcagtattaggatatttgtgccaattaaaggtcgtcctgctcctgaagtgacatggaccaaagataacatcaacctgaaaaaccgagccaacattgaaaatacggaatcatttactcttctgattatcccagaatgtaacagatatgataccggtaaatttgtcatgaccattgaaaacccggctgggaagaaaagtggctttgtgaacgtcagagtcttggacacgccaggcccagtcctcaacctgcggcctacagacatcacaaaggacagtgtcaccctgcactgggacctccctctgatagatggaggctcacgtataacaaactacattgtagagaaacgtgaagcaacacggaaatcttattccacagccaccactaagtgccataaatgcacatataaagttaccggcttgtctgaagggtgtgaatatttcttcagagtgatggcagagaatgaatatggaattggtgagccaacagaaactacagagcccgtaaaagcctctgaagcaccatctccaccagacagccttaacatcatggacataactaagagcaccgtcagcctggcatggcctaagcccaaacacgatggtggcagcaagatcactggctatgtgattgaagcccaaagaaaaggctctgaccagtggacccacatcacaaccgtgaaagggttagaatgtgttgtgaggaatctaactgaaggagaggaatataccttccaagtgatggcagtgaacagcgcggggagaagtgcccctagagaaagcagacccgtcattgtcaaggagcagacaatgcttccagagctggatctccgtggcatctatcagaaactggtcattgccaaagctggtgacaacatcaaagttgaaattccagtgctcggtcgaccgaagcccacagtgacatggaaaaaaggagaccaaattcttaaacagacacagagagttaattttgaaaccacagcgacttcaaccattttaaatatcaatgagtgtgtcagaagtgatagtgggccctatccattaacagcaaggaacattgtaggagaggttggtgatgtcatcaccattcaagtccatgatatcccagggccacctactggaccaatcaaatttgatgaagtttcatctgattttgtaaccttctcttgggacccacctgagaacgatggtggtgtaccaataagcaactatgtagtggaaatgcggcagactgacagtactacctgggttgagttagcaaccaccgttatacgtactacctataaagccacccgccttactactggattagagtatcagttccgtgtaaaagctcagaatagatatggagttggaccaggcatcacatcagcatgcatagttgccaactatccatttaaggttcctggacctcctggtacccctcaggtaactgcagttaccaaggattcaatgacaattagctggcatgagccactttctgatggtggaagccccattttaggatatcatgttgaaagaaaagaacgaaatggtattctctggcagactgtgagcaaagctttagtaccaggcaacattttcaaatcaagtggacttacagatggtattgcttatgagttccgggtgattgcagaaaacatggcaggcaaaagtaagccaagcaagccatcagaacctatgttggctctggatcccattgacccacctggaaaaccagtacctctaaatattacaagacacacagtaacacttaaatgggctaagcctgaatatactgggggctttaaaattaccagttatatcgttgaaaagagagaccttcctaatggacggtggctgaaggccaacttcagcaacattttggagaatgaatttacagtcagtggcctaacagaagatgctgcatatgaattccgtgtgatcgccaaaaatgctgcaggtgccatcagtccaccatctgagccatctgatgctatcacttgcagggatgatgttgaggcaccaaagataaaggtggatgttaaatttaaggacacggttatattaaaagcaggtgaagcattcagactggaagctgatgtttcaggccgcccacctccaacaatggaatggagcaaagatggaaaagagctggaaggcacagcaaagttagaaataaaaattgcagatttctctactaatctggtaaacaaagattcaacaagaagggatagtggtgcctatacccttacagcgactaatcctggtggctttgctaaacacattttcaatgtcaaagttcttgacagaccaggcccacctgaaggacctttggctgtaactgaagtgacatcagaaaagtgtgtactatcatggttccctccactggatgatggaggtgccaaaattgatcattacatagtacagaaacgtgaaaccagcagattggcatggacaaatgtagcctcagaagtccaagtaacaaagctaaaggtcactaaactcttgaaaggcaatgaatacatattccgtgtcatggctgtaaataaatatggagtgggagagccactggaatcagagcctgtgcttgcagtgaatccttatggaccccctgatccgcccaaaaaccctgaagtgacaactattactaaagattcgatggttgtctgctggggacatcctgattctgatggtggaagtgaaatcatcaattatattgtggaacggcgtgataaagctggccaacgctggattaaatgcaacaaaaaaactcttactgatttaagatataaagtgtctggactgacagaaggacatgaatatgagttcaggattatggctgaaaatgctgctggaattagtgcaccaagtcctaccagtccattttacaaggcttgtgacactgtgtttaaacctggaccaccaggtaacccacgtgttctggatacaagcagatcatccatttcaatcgcttggaataaacctatctatgatggtggttcagaaatcactgggtatatggttgagattgccctgccagaggaagatgaatggcagattgtcactccaccagcaggactcaaggcaacttcgtatactatcactggcctcacagagaatcaggaatataagatccgcatctatgccatgaattccgaaggacttggggaacctgcccttgttcctggaactccaaaggctgaagacagaatgctgcctccagaaattgaactggatgctgacctgcgcaaagttgttactataagggcctgctgcaccctgagactttttgttcccatcaaaggaaggcctgcacctgaggtgaagtgggcccgggaccatggagaatctttagataaagctagcatcgaatccacaagctcttacaccctgcttattgttggaaatgtaaacagatttgacagtggcaaatatatactaactgtagaaaatagttcaggcagcaagtctgcatttgtcaatgttagagttctcgatacaccaggccccccacaggatctgaaggtaaaagaggtcactaagacatctgtcacactcacatgggacccacctctccttgatggaggttcaaaaatcaagaactatattgttgaaaagcgggaatcaacaagaaaagcatattcaactgttgcaacaaactgccacaagacttcctggaaggtagaccagcttcaagaaggctgtagctactatttcagggttctcgcagaaaatgaatatggcattgggctgcctgctgaaaccgcagaatctgtgaaagcatcagaacgacctcttcctccaggaaaaataactttgatggatgtcacaagaaatagtgtgtcactctcttgggagaaaccagagcatgatggaggcagccgaattctaggctacattgtggagatgcagaccaaaggcagtgacaaatgggccacgtgtgccacagtcaaggtcactgaagccactatcactggattaattcagggtgaagaatactctttccgtgtttcagctcagaatgaaaagggcatcagtgatcctagacaactgagtgtgccagtgatcgccaaagatcttgtcattccaccagccttcaaactcctgttcaatactttcactgtactggcaggtgaagacctaaaagttgatgttccattcattggccgccctaccccagctgtaacctggcataaagataatgtaccactgaagcagacaactagagtaaatgcagagagcacagaaaataattcactactgacaataaaggacgcctgccgagaagatgttggccattatgtggttaaactgactaactcagctggtgaagctattgaaacccttaatgttatcgttcttgacaaaccagggcctccaactggaccagttaaaatggatgaagtgacagctgatagtattactctttcctggggcccacccaagtatgatggtggaagttctatcaataattacattgttgagaaacgggacacttccacaaccacctggcaaattgtatcagctacagttgcaaggacaacaataaaggcttgcagactgaagactggatgtgaatatcagtttagaattgcagctgaaaacagatatgggaagagtacctacctcaattcagagcctactgtagcccaatatccattcaaagttcctggtcctcctggcactccagttgtcacactgtcctccagggacagcatggaagtacaatggaatgagccaatcagtgatggaggaagtagagtcattggctatcatctagaacgcaaggaaagaaatagcatcctctgggttaagttgaataaaacacctattcctcaaaccaagtttaagacaactggccttgaagaaggtgttgaatatgaatttagagtctctgcagagaacatcgtgggcattggcaagccgagtaaagtatcagaatgttatgtggctcgtgacccatgtgatccaccaggacggccagaggcaatcattgtcacaaggaattctgtgactcttcagtggaagaaacccacctatgacggtggaagcaagatcactggttatattgttgagaagaaagaattacctgagggccgttggatgaaagccagttttacaaatattattgacactcattttgaagtaactggcctagttgaagatcacagatatgagttccgggttatagcccgaaatgccgcaggagtgtttagtgagccttcagaaagcacaggagcaataacagctagagatgaggtagatccaccacgaataagtatggatccaaaatacaaagacacaatcgtggttcatgctggtgaatcattcaaggttgatgcagatatttatggcaaaccaataccaaccattcagtggataaaaggtgatcaggagctttcaaacacagctcgattagaaataaagagcaccgactttgccaccagtctcagtgtaaaagatgcagtacgtgtcgacagtggaaattacatactgaaggccaaaaatgttgcaggagaaagatcagttactgtgaatgtcaaggttcttgacagaccagggccacctgaaggacctgttgttatctcaggagttacagcagaaaaatgcacactagcttggaaacccccacttcaggatggtgggagtgacatcataaattatattgtggaaaggagagaaaccagccgcttagtttggactgtggttgatgccaatgtgcagactctcagctgcaaggttactaagcttcttgaaggcaatgaatatactttccgtataatggcagtaaacaaatatggtgttggtgaacctcttgaatctgagccagtagttgccaagaatccatttgtagtaccagatgcaccaaaagctccagaagtcacaacagtgaccaaggactcaatgattgttgtatgggaaagaccagcatctgatggtggtagtgaaattcttggatatgttcttgagaaacgggataaagaaggcattagatggacaagatgccataagcgtctgattggagagttgcgcctgagagtaactggactcatagaaaatcacgattatgagttcagagtttctgctgagaatgctgctggacttagtgaaccaagccctccttctgcttaccaaaaggcttgtgatcctatttataaaccaggacccccaaacaaccccaaagtcatagacataaccagatcttcagtattcctttcttggagcaaaccaatatatgatggtggctgtgaaattcaaggatacattgttgaaaaatgtgatgtgagtgttggtgaatggacaatgtgcactccaccaacaggaattaataaaacaaacatagaagtagagaagctgttggaaaagcatgaatacaacttccgtatctgtgctattaataaagctggagttggagaacatgctgacgtccctggacctattatagttgaagaaaaattagaagcaccagacattgatcttgacctagaactaaggaaaatcataaatataagggcaggtggctccttaaggttatttgttcctataaaaggtcgtcctacaccagaagttaaatggggaaaggtggatggtgaaatccgagatgcagctataattgatgtcactagcagtttcacctctcttgttcttgacaatgtcaaccgatatgatagtggaaaatatacgcttacattagaaaacagcagtggaacaaagtctgcctttgttactgtgagagttctggacacgccaagtccacctgttaacctgaaagtcacagaaatcaccaaagactcagtatcaattacatgggaacctcctttgttggatgggggatccaaaataaaaaattacattgttgagaaacgtgaagccacaagaaaatcatatgctgctgttgtaactaactgccataagaattcttggaaaatcgatcagctccaagaaggttgcagttattactttagagtcacagctgagaatgagtatggtattggccttcctgcccagactgctgatccaattaaggttgcagaagtgccacaacctcctggaaaaataactgtggatgatgtcaccagaaacagtgtctctctgagttggacaaaacctgaacatgatggtggcagtaaaatcattcagtatattgtggaaatgcaagctaaacacagtgagaaatggtcagagtgtgctcgagtaaagtctcttcaggcagtaattaccaacctaactcaaggggaagaatatctttttagagttgttgctgtaaatgaaaaggggagaagtgatcctcggtcccttgcagttccaatagttgccaaagatctggtaattgagccagatgtaaaacctgcattcagtagttacagtgtacaggttggccaagatttgaaaatagaagtgccaatttctggacgtcctaagccaaccattacctggactaaagatggtctcccactgaagcagaccacaagaatcaatgttaccgattcactggatctcaccacactcagtattaaagaaactcataaggatgatggtggacaatatggaatcacagttgccaatgttgttggtcagaagacagcatccatcgaaattgtaactctagataaacctgatcctccaaaaggacctgttaaatttgatgacgtcagtgctgaaagtattacattatcttggaaccctccattatatacagggggctgccaaatcaccaactacattgttcagaaaagagatacaaccaccacagtatgggatgttgtttctgctactgttgctagaactacactcaaagtgaccaaactgaaaactggtacagaataccaatttagaatatttgccgaaaacagatatggacaaagctttgccttagagtctgatccaattgtagctcaatatccctacaaagaaccaggccctccaggtacaccatttgccacagccatttccaaagactccatggtcatacagtggcatgaaccagtcaacaatggtggaagccccgtcataggttaccacctggagagaaaagaaagaaacagtattttgtggacaaaggtcaacaaaactattattcatgacacccaattcaaagcacagaatcttgaagaaggcattgaatatgaattcagagtgtatgctgaaaatattgttggtgtaggcaaagcaagcaagaattctgaatgctatgtagccagagatccctgtgacccaccaggaaccccagaaccaataatggttaaaagaaatgaaatcactttacagtggaccaaacctgtgtatgatggtggaagtatgattacaggctacattgtagagaaacgtgatttgcctgatggtcgttggatgaaagctagctttacaaatgtcattgaaactcaatttactgtgtcaggtcttactgaagatcaaagatatgaattcagagtcattgcaaagaatgcagctggtgcaataagtaaaccctctgacagtactggaccaataactgccaaggatgaggttgaactcccaagaatttcaatggatccaaaattcagagacacaattgtggtaaatgctggagaaacattcagacttgaggctgatgtccatggaaagcccctacctaccattgagtggttaagaggagataaggaaattgaagaatctgctagatgtgaaataaagaacacagatttcaaggctttacttattgtaaaagatgcaattagaattgatggtgggcagtatattttaagagcttccaatgttgcaggttctaagtcattcccagtaaatgtaaaagtattagatagaccaggacctccagaagggccagtccaggttactggagtcacttctgaaaaatgctctttaacatggtctccaccacttcaagatggtggcagtgacatttctcactatgttgttgaaaagcgagaaaccagtcgacttgcctggactgttgttgcttcagaagttgtgaccaattctctgaaagttaccaaactcttagaaggtaatgaatatgttttccgtataatggctgtcaacaaatatggtgttggagagcctttggaatctgcaccagtactaatgaaaaatccatttgtgcttcctggaccaccaaaaagcttggaagtcacaaatattgccaaagactccatgaccgtctgttggaaccgtccagatagtgatggtggaagtgagattattggttacattgtagagaaaagagacagaagtggcattcgatggataaaatgtaataaacgccgcattacagatttgcgtctaagagtgacaggattaacagaagatcatgagtatgaattcagggtctctgcagaaaatgctgctggagttggggaaccaagtccagctacagtttattataaagcctgtgatcctgtgttcaaacctggcccacctaccaatgcacacattgtagacaccactaaaaattcaatcacacttgcctggggtaaacccatctatgatggcggcagtgagatcttgggatatgtagtagaaatctgtaaagcagatgaagaagaatggcaaatagttactccacagactggcctgagagtcactcgatttgaaatttcaaaactcactgaacaccaagagtataaaatacgagtctgtgccctcaacaaagttggtttaggtgaggctacatcagttcctggtactgtgaaaccagaagataaacttgaagcacctgaacttgaccttgactccgaattaagaaaaggaattgttgtaagagctggtggatctgccagaattcacattccattcaaaggtcgtccaacgcctgagatcacttggtctcgagaggaaggtgaattcacagataaggtccaaattgaaaagggagtaaactatacccaactatcaatagataactgtgatagaaatgatgctggaaaatacattcttaagttggaaaacagcagtggatcaaagtctgcttttgtaactgtgaaagttcttgacactccaggaccaccacagaatttggcagtcaaagaagtgagaaaagattctgccttcctggtatgggagccacccatcattgatggaggggcaaaggtcaagaactatgtgattgacaaacgtgagtcaaccagaaaagcgtatgctaatgtgagtagtaaatgcagcaaaacaagttttaaagtggaaaaccttacagaaggagccatttattacttcagagtcatggctgaaaatgaatttggagttggtgttccagtggaaactgttgatgccgtgaaagctgctgaacctccttccccaccaggaaaggttacactcactgatgtgtcccagaccagtgcatcacttatgtgggagaaacctgaacatgatggcggtagcagagtcctggggtacgttgttgaaatgcagcccaaaggaactgaaaaatggagcattgtggctgaatccaaagtctgtaatgcagttgttactggtttgagttctggacaagaatatcagttccgtgtcaaggcttataatgagaaaggaaaaagcgatccaagagtgttgggtgttcctgtcatagccaaggacttgactatacagcctagtttaaagttaccatttaacacatatagtatccaagctggagaagatcttaaaatagaaattccagttataggccgaccaagacctaacatttcttgggtcaaagatggtgagcctcttaaacagacaacaagagtaaacgttgaagaaacagctacctcaactgttttgcacattaaagaaggtaacaaagatgactttggaaaatacaccgtaacggcaacaaatagtgcaggcacagcaacagaaaatctcagtgttatcgttttagaaaagcctggacctccagttggcccagttcggtttgatgaagttagtgcagactttgtagtcatatcttgggaacctccagcctatactggtggctgccaaataagcaactacattgtagagaagcgagatacaaccaccaccacttggcacatggtatcagcaacagttgcaagaacaacaattaaaataaccaaactgaaaacaggcacggagtaccagtttagaatttttgctgaaaacaggtatggaaaaagtgccccactggattctaaggcagttattgtacaatatccatttaaagaacctggaccacctggaactccttttgtgacatcaatctcaaaagatcagatgcttgtgcaatggcatgagccagtgaatgatggaggcaccaaaattattggctaccatcttgaacagaaagaaaagaacagtattttatgggtcaagttaaataagacccccattcaggacaccaaattcaaaacaactgggcttgatgagggccttgagtatgagttcaaagtttctgctgaaaatattgttggcattggcaagcctagcaaagtgtcagaatgctttgttgctcgtgatccatgtgacccacctggtcgccctgaagccattgttattacaagaaacaatgtcacactgaaatggaagaaacctgcctatgatggtggtagcaaaataacaggttatattgtagaaaagaaagatctacctgatggccgctggatgaaagccagctttaccaacgtattagaaactgaatttacagtgagtggacttgtagaagaccaaagatatgaatttagagtaattgcaagaaatgcagctggaaactttagtgaaccatctgatagtagtggtgccattactgcaagagatgaaattgatgcaccaaatgcctctctggatccaaaatataaagatgtcatcgttgttcatgcaggagagacttttgttcttgaagccgacatccgtggcaaacctatacctgatgttgtttggtcaaaagatggaaaagaacttgaagaaacagctgctagaatggaaattaaatctactattcagaaaacaactcttgttgtcaaagactgtatacggactgatggaggacaatatattctgaaactcagcaatgttggtggtacaaagtctatacccatcactgtaaaggtacttgacaggccagggcctcctgaagggcctctgaaagttactggagttactgcggaaaaatgttacctggcatggaacccacctttgcaagatggtggtgctaatatttcacattacatcattgaaaagagggagacaagccgactctcttggacccaggtttcaactgaggtacaggcccttaactacaaagttactaaacttcttcctggtaatgagtacattttccgtgtcatggctgtgaataaatatggaattggagagcccttggaatctgggcctgttacggcctgtaatccttataagccaccaggtcctccctcaacacctgaagtctcagcaatcaccaaagattctatggtagtaacatgggcacgcccagtagacgacggaggtaccgaaattgagggctacattcttgaaaaacgagataaggaaggcgttagatggaccaagtgcaacaagaaaacattaacggatctgcggctcagggtaactggtcttaccgaaggccattcctatgaattcagagttgctgctgaaaatgcagctggtgtgggagaacctagtgagccatctgttttctaccgtgcgtgtgatgccttgtatccaccaggtcccccaagcaatccaaaagtgacggacacttccagatcttctgtctccctggcatggagtaagccaatttatgatggtggcgcacctgttaaaggctatgttgtagaggtcaaagaagctgctgcggatgaatggacaacctgcactccaccaacaggattacaaggaaagcagttcacagtgaccaagcttaaagaaaacactgaatataacttccgtatttgtgccatcaattctgaaggtgtaggtgaacctgcaactctacctggctcagtggttgctcaggagaggatagagccaccagaaatagaactcgatgctgatctcagaaaggtggtcgttctgcgtgcaagtgctactttacgcttatttgtcactatcaaaggtcgaccagaacccgaagttaaatgggaaaaggcagaaggcattctcactgacagggctcagatagaggtgaccagctcatttacaatgttggtgattgataatgttaccagatttgacagtggtcggtataatctgacattagaaaataatagtggctccaaaacagcttttgttaacgtcagagttcttgactcaccaagtgcccctgtgaatttgaccataagagaagtgaagaaagactcagtgacgttgtcctgggaaccaccacttattgatggtggagctaagattacaaactacattgtcgaaaaacgagaaactacaagaaaagcctatgctaccattacaaataattgcactaaaactactttcagaattgaaaatctacaagaaggatgttcttactacttccgagtcttggcttccaatgaatatgggattggtttgccagctgaaacaacagaacccgttaaagtgtctgaaccacccctcccacctggaagagtaactcttgttgatgtgacccgtaatacagctacaattaagtgggagaaaccagaaagtgatggtggcagcaaaattactggttatgtggttgaaatgcagactaaagggagtgaaaagtggagcacctgcacacaagttaagactctagaagcaactatatctggcttaactgcaggagaagagtatgtcttcagggtagctgcagttaacgaaaagggaagaagtgatccaagacaacttggagtgccagtaattgcaagggatattgaaataaagccttcagttgagcttcctttccatactttcaatgtaaaggctagagaacaacttaagattgatgtgccattcaaaggaagacctcaagctactgtgaactggagaaaagatggtcagactcttaaagagacaactagagtcaatgtttcttcttcaaagactgtaacatcactatctattaaggaagcttcaaaggaagatgttggaacttatgaattatgtgtttcaaacagtgctggatccataacagttcctattactataattgtccttgacagaccaggacctccaggtcctatacgtattgatgaggttagttgtgacagcataaccatttcttggaatcctccagaatatgatggtggctgccaaattagcaattacattgttgaaaagaaagaaaccacctctacaacatggcacatagtttcacaagcagttgcaagaacatccattaaaatagttcgcctgacaacaggaagtgagtatcagttccgtgtttgtgcagaaaaccgctatggaaagagctcctacagtgaatcttcagctgttgttgcagagtatccattcagtcccccaggtcctcctggtactcctaaagttgtgcatgccacaaaatctaccatgcttgtaacctggcaagtgccagttaatgatggaggaagtcgagtaattggctatcatcttgagtataaagaaagaagcagcattctttggtcaaaagcaaataaaatcctcattgctgatactcaaatgaaagtctccggccttgatgaaggactgatgtatgagtatcgtgtatatgctgaaaatattgctggaattggtaaatgcagtaaatcttgtgaaccagtccctgcaagagatccttgtgaccctcctggacaacctgaagtcacaaatatcacaagaaaatcagtgtcacttaaatggtctaaaccacattatgatggtggagctaagatcacaggatacattgttgaacgcagagaactaccagatggccggtggctgaagtgcaattatactaatatacaagaaacatactttgaagtaactgaacttactgaagatcagcgttatgaattccgggtttttgcaaggaatgctgctgactcagttagtgagccatctgaatccactgggcctattatagttaaagatgatgttgagcctccaagagttatgatggatgtcaagttccgagacgttattgttgtcaaagctggagaggtccttaagataaatgcagacattgcagggcgacctctgccagtaatttcctgggccaaggatggtatagaaattgaagaaagagcaagaacagaaatcatctcaacagacaatcatactttgttaacagttaaagactgtataagacgagacactgggcaatatgtactaacactgaagaatgttgccggcactcggtctgtggccgttaattgcaaagtacttgataagcctggtccaccagcaggaccacttgaaataaatggcctcactgctgagaaatgctctctttcctggggacgtccccaagaagatggtggtgcagatatcgactattacatcgtagaaaaacgtgaaacaagccaccttgcatggacaatatgtgaaggagagttacagatgacatcctgtaaagtaaccaagttactcaaaggcaatgaatatatatttagagtaactggtgttaataaatatggtgttggtgagcccctagagagtgtagctataaaggcactagatccatttacagttccaagtccacccacgtctttggaaattacttctgtgaccaaagaatctatgacactttgctggtcaagacccgagagtgatggaggtagtgaaatatctggatatataattgaaaggcgagagaaaaatagcctaagatgggtgcgtgtaaacaaaaaaccagtttatgatctaagagtgaaatcaacaggacttcgggaaggatgtgaatatgaatatcgtgtttatgcagaaaatgctgctggcctaagtcttccaagtgaaacctctcccttaattagggcagaagatccagtgttcctaccatctcctccatccaaacccaaaattgtggactcaggcaagacaactataactattgcctgggttaagccgctgtttgatggtggggccccgataactggatatactgtagaatacaaaaaatctgatgacactgactggaaaacttccattcagagcttacgagggacagaatatacaataagcggactaacaacaggagctgaatatgttttcagagtaaaatctgtcaataaggttggtgctagtgaccccagtgatagctctgaccctcagatagcaaaggaaagagaagaagaacctttatttgatattgacagtgaaatgaggaagaccttgattgtcaaggctggtgcctcatttaccatgactgtgcctttccgaggaagaccagtacccaatgtcttgtggagtaagccagacactgacctccgtactagagcttatgttgataccacagactctcgtacatcactgaccattgaaaatgccaacagaaatgactctggaaagtacacattaacaattcagaatgttttgagtgctgcttcactgaccttagttgtcaaagttttagataccccaggtcctccaaccaacattactgtgcaagatgtaaccaaagagtctgcagtgttatcctgggatgttcctgaaaacgatggtggagcaccagtgaagaattaccacatagaaaaacgtgaggccagcaagaaagcatgggtctctgtgaccaacaactgtaaccgcctctcctacaaagttaccaatttacaagaaggagctatctattacttcagagtctctggagaaaatgagtttggtgttggtataccagctgaaacaaaggaaggagtaaaaataacagaaaaaccaagcccacctgaaaaacttggagtaacaagtatatccaaagacagtgtttccctgacctggctgaagcctgaacatgatggcggaagcagaattgtacactatgtcgttgaagcactagaaaaaggacagaaaaactgggttaaatgtgcagtggcaaagtcaacccatcacgttgtttccggtctgagagagaattctgaatactttttccgagtgtttgctgaaaatcaagctggcctgagtgacccgagagagcttctgcttcctgttcttattaaggagcaactagaaccacctgaaattgatatgaagaatttcccaagtcacactgtatatgttagagctggttcaaaccttaaagttgacattccaatctctggaaaaccacttcccaaagtgaccttatcaagagatggtgtcccccttaaggcaaccatgagatttaataccgaaattactgctgagaacctgaccatcaatctcaaagaaagtgttacagctgacgctgggagatatgaaatcactgctgccaactccagtggtacaaccaaagctttcattaacattgttgtgctagacaggcctggtcctccaactggccctgttgttattagtgatataactgaagaaagtgtgactctcaaatgggagccacctaagtatgacggtggaagtcaagttaccaactacattctactcaaaagagaaacaagtactgcagtgtggactgaagtgtctgcaacagttgcaagaaccatgatgaaagtcatgaaactgaccacaggagaagaataccaattccgcatcaaggcagaaaaccgctttggcatcagtgatcatatagattcagcttgtgtgactgtcaaactaccatacacaacacctggaccaccatctacaccatgggtcactaatgttactcgagaaagcatcactgtgggctggcatgaaccagtgtcaaatggaggcagtgcagtcgtaggctatcacctggaaatgaaagacagaaacagtattttatggcaaaaagccaacaaactggtcatccgcacaactcacttcaaagtcacaacaatcagtgctggacttatttatgaattcagggtgtatgcagaaaatgctgctggagttggaaaacctagccatccttctgaaccagtcttggcaattgatgcttgtgaacccccaagaaatgttcgtatcactgatatttcaaagaactctgtcagcctttcatggcaacaaccagctttcgatggaggtagcaagattacaggctacattgttgagagacgtgaccttccagatggcagatggaccaaggccagcttcaccaatgttactgaaactcaattcatcatctctggcttgactcagaattcccagtatgaattccgtgtctttgctaggaatgctgttggttccattagcaatccatctgaggttgtagggcccattacttgcatcgattcttatggtggtcctgtaattgatttgcctctagaatatacagaagttgtcaaatacagagcaggtacatctgtgaagctcagagctggcatttctggcaaacctgcgcctactattgagtggtataaagatgataaagaattacaaaccaatgcactggtgtgtgttgaaaataccacggacctcgcatctatactcatcaaagatgccgatcgccttaatagtggatgctatgaattaaaactaaggaatgccatgggctcagcctcagccaccatcagagtacagatccttgacaaaccaggcccacctggtggaccaattgaatttaagactgtaactgctgagaagatcacccttctctggcggcctccagctgatgatggtggtgcaaaaatcactcactacattgtggaaaagcgtgagacaagccgcgttgtgtggtctatggtgtctgaacatttggaagagtgcatcattacaaccaccaaaattatcaaaggaaatgaatacatcttccgggtccgagccgtgaacaaatatggaattggcgagccactggaatctgattccgttgtagccaagaacgcatttgttacacctgggccaccaggcataccagaagtgacaaagattaccaagaattcgatgactgttgtatggagcaggccaattgcagatggcggtagtgatataagtggctatttccttgaaaaacgagacaagaagagcctaggatggtttaaagtactaaaagagactatccgtgacaccagacaaaaagtaacaggactcacagaaaacagtgactatcaatacagagtttgtgctgtaaacgctgctggacagggtccattttctgaaccatctgaattctacaaagctgctgatcctattgatcctccaggtccacctgctaagataagaatcgcagattcaaccaagtcatccatcacccttggctggagtaagcctgtctatgatgggggcagtgctgttactgggtatgttgtcgagataagacaaggagaggaagaggaatggactactgtctctaccaaaggagaggtcagaactacagaatatgtggtatccaacctgaaacctggagtcaattactacttccgggtatctgctgtaaactgtgctggacaaggagaacctatagaaatgaatgaacctgtacaagctaaagatatacttgaggcaccagagattgacctggatgtggctctcagaacttctgttattgccaaagctggtgaagatgtacaagtgttgattccctttaaaggcagacctccacctactgtcacatggagaaaagatgagaagaatcttggcagtgatgccagatacagcattgaaaacactgattcatcctcattactcaccattcctcaagttactcgcaatgatacaggaaaatatattctcacaatagaaaatggagttggtgaacctaagtcttcaactgtgagtgttaaagtgcttgacacaccagctgcctgccagaaactacaggttaaacatgtttctcgaggcacagtcactttgctctgggatcctcctctcattgatggaggatctccaataattaattatgtcattgaaaagagagatgccaccaagagaacatggtctgtcgtgtcacacaaatgttctagcacatccttcaagctaatagatttgtcggagaagactccattcttcttcagagttcttgcagaaaatgaaattggaattggggaaccctgtgaaactacagagccagtgaaggctgctgaagtaccagctcctatacgtgatctctcaatgaaagactcaacaaagacatctgtcatcctcagctggaccaaacctgactttgatggtggtagcgtcatcacagaatatgttgtagaaaggaaaggtaaaggtgaacagacgtggtcccacgctggcataagtaagacatgtgaaattgaggttagccaacttaaggagcagtcagtcctggagttcagagtgtttgccaaaaatgagaaaggactgagtgatcctgtcactattgggccaattacagtgaaagaacttattattacacctgaagttgacctgtcagatatccctggggcacaagtcactgtgagaattgggcacaatgtgcaccttgaattaccttataagggaaaacccaaaccatccatcagttggctgaaagatggcttgccactgaaagaaagtgaatttgttcgcttcagtaaaactgaaaacaaaattactttgagtattaagaatgccaagaaggagcatggaggaaaatacactgttattcttgataatgcagtgtgtagaattgcagtccccattacagtcatcacccttggcccaccatcaaagcccaaaggacccattcgatttgatgaaatcaaggctgatagtgtcatcctgtcatgggatgtacctgaagataatggaggaggagaaattacttgttacagcatcgagaagcgggaaacttcacaaactaactggaagatggtgtgttcaagtgttgccagaacgactttcaaagttcctaatctagtcaaagatgctgagtaccagtttagagtgagagcagaaaacagatacggagtcagccaaccacttgtctcaagcattattgtggcaaaacaccagttcaggattcctggtcccccaggaaagccagttatatacaatgtgacttctgatggcatgtcactaacttgggatgctccagtttatgatggtggttcagaagttactggattccatgttgaaaagaaagaaagaaatagcatcctctggcaaaaagttaatacatcaccaatctctggaagagaatatagagccactggactggtagaaggtctggattaccaattccgtgtatatgctgaaaattctgctggcctaagctcacctagtgacccaagcaaatttaccttagctgtttctccagtagacccacctggcactcctgactacattgatgtcacccgggaaaccatcacacttaaatggaacccaccattgcgtgatggaggcagtaagattgtgggctatagcattgagaaacggcaaggaaatgaacgctgggtgagatgcaactttactgacgtcagtgaatgtcagtacacagttacaggactcagtcctggggatcgctatgagttcagaataattgcaagaaatgctgttggaactataagcccgccctcacagtcttctggcattattatgacaagagatgaaaatgttccaccaatagtagagtttggccctgaatactttgatggtctcattattaagtccggagagagccttagaattaaagctttggtacaaggaagaccagtgcctcgagtaacttggttcaaagatggagtggaaatcgaaaagaggatgaatatggaaataaccgacgtacttggatccaccagcctatttgttagagatgctactcgggaccatcgtggtgtatacacagtggaagccaaaaatgcatctggttctgcaaaagcagaaattaaagtgaaagtacaagatacaccaggaaaagtagttgggccaataagattcaccaatattactggggagaagatgactctgtggtgggatgccccactcaatgacggttgtgctcccataacccactacatcattgaaaaacgggaaaccagcagacttgcctgggcactaattgaggataaatgtgaagcccaaagttacactgccattaaactaataaacggcaatgaataccaattccgtgtttctgcagttaacaagtttggtgttggcaggccacttgattctgatccagtggttgctcaaatacaatatactgttcctgatgcccctggcattccagaacctagcaacataacaggcaacagcattaccctgacatgggcaaggccagaatcagatggtggcagtgaaattcaacagtatatccttgaaagaagagaaaagaaaagcacaagatgggtaaaagtgatcagcaaacgaccaatctctgaaacaagattcaaagtcactggtctgacagaaggcaatgagtatgaattccatgtcatggctgaaaatgctgcaggagttggacctgcaagtggcatctcaagactcattaaatgtagagagcccgtcaacccaccaggtcctcccacagtggtcaaagtaacagacacatcaaagacaactgtgagcttagaatggtccaaaccagtgtttgatggtggcatggaaataattgggtatattattgaaatgtgtaaggccgacttaggagactggcacaaggtgaatgcagaggcatgtgtgaaaacaagatatacagtcactgatctacaagcaggtgaagaatacaaattccgagttagtgctatcaatggtgctggaaaaggcgacagctgtgaagtgactggcacaattaaagcagttgaccggttaacagctcctgagttagacatagatgcaaacttcaaacagactcatgttgttagagctggggccagtattcgcctcttcattgcctaccaaggtagacctactcctacagctgtgtggagcaaaccagactctaaccttagccttcgggctgatatccatacaacagattccttcagcaccctcactgtggaaaactgcaacagaaatgatgcagggaaatatacccttactgtggaaaacaacagtggtagtaagtcaatcacattcaccgtgaaagtgctagacactccaggcccacctggcccaattaccttcaaagatgtgacccggggatctgctacattgatgtgggatgcccctcttcttgacggtggtgcccgaatccatcattatgtggtagagaaacgagaggcaagtcgccgtagttggcaggttatcagtgaaaaatgcactcgtcagatcttcaaggtcaatgacctggccgaaggtgttccgtactatttccgtgtttctgcagtaaatgagtatggtgttggtgagccctatgaaatgccagaaccaattgtagccacagaacagcctgctccacctaggagacttgatgttgttgatactagcaaatcctccgcagtcttagcttggcttaaacctgaccacgatggaggcagccggatcactggctacctgcttgaaatgagacaaaagggatctgacttctgggttgaagctggtcacaccaaacagctaactttcacagtagagcgtcttgttgagaaaactgaatatgaattccgtgtgaaggccaagaatgatgctggctatagtgaacccagagaagccttctcttctgtcatcattaaggagcctcaaatcgagcccactgctgacctcactggaattaccaatcagcttataacttgcaaagcaggaagcccatttaccattgacgtaccaatcagtggtcgtcctgcccccaaagtaacatggaaactggaagaaatgagacttaaagagacagatcgagtgagcattacaacaacaaaagacagaaccacactgactgtaaaggacagcatgagaggtgactctggaagatacttcttgaccctggaaaatacagctggtgttaaaacatttagcgtcacagttgtggtcattggaaggccaggtccagtaaccggccccattgaggtctcatctgtctcagctgaatcgtgtgtcctgtcatggggagaacctaaagatggaggaggcactgaaattactaattacatagttgaaaagcgtgaatcgggtacaacagcttggcagcttgtcaattccagtgtcaagcgcactcaaattaaagtcactcatctcacaaaatacatggaatattctttccgtgtcagttcagagaacagatttggtgtcagcaaacctctagaatcagcaccaataattgctgaacatccatttgtcccaccaagcgctcctaccagacctgaggtctaccatgtgtctgccaatgccatgtctattcgttgggaagaaccctaccacgatggtggcagtaaaatcattggctactgggttgagaagaaagaacgtaatacaattctttgggtgaaagaaaacaaagtgccatgcttagagtgcaactacaaagtaactggtttagtagaaggactggaatatcagttcagaacttatgcactcaatgctgcaggtgttagcaaggccagcgaagcttcaagacctataatggctcaaaatccagttgatgcaccaggcagaccagaggtgacagatgtcacaagatcaacagtatcactgatttggtctgccccagcgtatgatggaggcagcaaggttgtgggctacatcatagagcgtaagccagtcagtgaggtaggagatggtcgctggctgaagtgcaactacaccattgtatctgacaatttcttcaccgtgactgctctcagtgaaggagacacttatgagttccgtgtgttagccaagaatgcagcaggcgtaattagcaaagggtctgaatctacaggccctgtcacttgccgagatgaatacgctccacccaaagccgaactggatgcccgattacacggtgatctggttaccatcagagcaggttctgatcttgttctggatgctgcagttggtggcaaacctgaacccaaaattatctggaccaaaggagacaaggagctagatctctgtgaaaaagtctctttgcagtatactggcaaacgagcaactgctgtgatcaagttctgtgacagaagtgacagtggaaaatacactttaacagtgaaaaatgccagcgggaccaaggccgtgtctgtcatggtcaaagtgcttgattcccctggcccatgtggaaagctcaccgtcagcagagtaacacaggagaagtgcactttagcctggagccttccgcaggaagacggaggagcagaaatcactcactacatcgtggaaagacgcgagactagcaggctcaactgggtgattgttgaaggcgaatgcccaaccctatcctatgtcgttaccaggctcatcaagaacaatgagtacatattccgagtgagggcagtaaacaaatatggccctggtgtgcctgttgaatcagagccaattgtagccagaaactcattcactattccatcaccacccggcatacctgaagaagttgggactggcaaagagcatatcatcattcagtggacaaaacctgaatctgatggtggcaatgaaatcagcaactacctagtagacaaacgtgagaagaagagcctgcgctggacacgtgtcaacaaagactatgtggtgtatgataccaggctgaaggtgaccagcctgatggagggttgtgattaccagttccgggtgaccgcagtgaatgcagctggtaacagtgagcccagcgaagcttccaacttcatctcatgcagagaaccatcatatacccctggaccaccttctgctccaagagttgtggataccaccaaacacagcattagtttggcatggaccaaacccatgtacgatggtggtactgacattgtaggatatgttctggaaatgcaagagaaggacactgatcagtggtaccgagtgcataccaatgccacaataagaaatactgaattcactgtgccagaccttaaaatgggccagaaatattccttcagagttgctgccgtgaacgtgaagggtatgagcgaatacagcgaatcaattgctgaaattgagcccgtggaaagaatagaaataccagatcttgagcttgcagatgatctaaagaagactgtgaccatcagggctggggcctccttgcgcttgatggtgtctgtatctggaagaccacctcctgtcataacgtggagcaagcagggcattgaccttgcaagccgggcaattattgacaccactgagagctactcattgctaatagtggacaaagttaatcggtacgatgctggaaaatacacaattgaagctgaaaaccaatctggcaagaaatcagcaacagtccttgttaaagtctatgatactcctggtccctgtccttcagtgaaagttaaggaagtatcaagagattctgtgactataacttgggaaattcccacgattgatggtggagctccagtcaacaattacatcgttgagaagcgtgaagctgctatgagagcattcaaaacagtaactaccaaatgcagcaagacactttacagaatttctggacttgtagaaggaaccatgtactatttcagagtgctgccagaaaatatttatggcattggagaaccttgtgaaacatctgatgcagtactggtctcagaagtgcctttggtgcctgcaaagctagaagtggtcgatgtcaccaaatccactgttacccttgcctgggaaaaaccactctacgatggtggtagccgactcactggatatgttctcgaggcctgcaaagctggcacagagagatggatgaaggttgtcaccttaaaacccacagtcctagagcacactgttacttccttaaatgaaggtgaacaatacttatttagaataagggcacaaaatgagaaaggtgtgtcagaaccaagagagactgtcacagccgtgactgtacaagacctcagagtgttgccaacaatcgatctttctacaatgcctcagaagaccatccatgtcccagctggcagaccagtagagctggtgatacctattgctggccgtccacctcctgctgcttcctggttctttgctggttctaaactgagagaatcagagcgtgtcacagttgaaactcacactaaagtagctaaattaaccatccgtgaaaccactatcagagatactggagaatacacacttgaattgaagaatgttaccggaactacttcagaaaccattaaagttatcattcttgacaagcctggtccaccaacaggacctattaagattgatgaaattgatgctacatcaattaccatttcctgggaaccacctgaattggacggtggtgctccactgagtggttatgtggtagaacaacgtgacgctcatcgtccaggatggctgcccgtttctgaatcagtgactaggtccacgtttaagtttaccagactcaccgaaggaaatgagtatgtgttccgtgtggctgcaacaaaccgcttcgggattggctcttacttgcagtctgaggtcatagagtgtcgcagcagcatccgtattcctggacccccagaaacattacagatatttgatgtttcccgtgatggcatgacacttacttggtacccaccagaggatgacggtggctcccaagtgactggatatattgtggagcgcaaagaagtgagagcagatcgatgggtccgtgtaaataaagtacctgtgacaatgacacggtaccgctccactggccttactgaaggcttagaatatgaacaccgtgtcacagccattaatgcaagagggtctgggaaaccaagtcgtccttccaaacccatcgttgccatggatccaattgctcctccaggaaagccacaaaacccaagagttactgatacaacaaggacatcagtctccctggcctggagtgttccagaagatgaaggaggatctaaagtcacaggctacttgattgaaatgcaaaaagtagatcaacatgaatggaccaagtgtaacaccactccaaccaagattcgagagtatactctaacacacctacctcagggtgcagaatacaggttccgcgtcctagcttgtaatgctggtggacctggtgagcctgctgaggtaccaggaacagtcaaagtcactgaaatgcttgaatatcctgattatgaacttgatgaaagataccaagaaggtatctttgtaaggcaaggtggcgtcatcagacttaccataccaatcaaaggaaaaccattcccaatatgtaaatggaccaaggaaggccaggatattagtaagcgtgccatgattgcaacatctgaaacacacactgagcttgtgatcaaagaagcagacaggggtgattctggcacttatgacctggttctggaaaataaatgtggcaagaaggctgtctacatcaaggtcagggtgataggaagtcccaacagtccagaagggccactggaatatgatgacatccaagtccgctctgtgagggtcagctggagacctcctgctgatgatggtggtgctgacatcttaggctacatcctcgagagacgagaagtgcctaaagccgcctggtataccattgattccagagtccgaggtacatctctggtggtaaaaggcctcaaagagaatgtagaataccatttccgtgtttcagcagaaaaccagtttggcataagcaaacccttgaaatctgaggaaccagtcacaccaaaaacaccattgaatcctccagaacctccaagcaatcctccagaagtactcgatgtaaccaagagttctgttagcttgtcctggtcccggcccaaagatgatggtggttctagagtcacaggctactacatcgaacgcaaagagacatccactgacaagtgggtcagacacaacaagactcagatcaccaccacaatgtacactgtcacagggcttgttcccgatgctgagtatcagttccgcatcatcgcacagaatgatgttggcctgagtgagaccagccctgcttctgaaccagttgtttgcaaagatccatttgataaaccaagccaaccaggagaacttgagattctttcaatatccaaagatagtgtcactctacagtgggagaaacctgaatgtgatggtggtaaagaaattcttggatactgggttgaatatagacagtctggagacagtgcctggaagaagagcaataaggaacgtattaaggacaagcaattcacaataggaggtttgctggaagctactgagtatgaattcagggtttttgctgagaatgagactgggctgagcagacctcgcagaactgctatgtctataaagactaaactcacatctggagaggccccaggaatacgcaaagaaatgaaggatgttaccacaaaattgggtgaagctgctcaactctcatgccagattgttggaaggcctcttcctgacattaaatggtacagatttggtaaagagctcatacaaagccggaaatacaaaatgtcttcagatggacgcacacacactcttacagtaatgacagaggaacaggaagatgaaggtgtttatacctgcatagccaccaatgaggttggagaagtagaaaccagtagtaagcttctcctgcaagcaacaccgcagttccatcctggttacccactgaaagagaaatattatggagctgtgggttccacacttcggcttcatgttatgtacattggtcgtccagtacctgccatgacttggttccatggtcagaaacttttgcaaaactcagaaaacattactattgaaaacactgagcactatactcatcttgtcatgaagaatgtccaacgtaagactcatgctgggaaatacaaagtccagctcagcaatgtttttggaacagttgatgccatccttgatgtggaaatacaagataaaccagacaaacctacaggaccaattgtgatcgaagctctattgaagaactccgcagtgatcagctggaaaccacccgcagatgacggaggctcctggatcaccaactatgtggtggaaaaatgtgaggccaaggagggggctgaatggcaattggtgtcttcagccatctcagtgacaacctgtagaattgtgaacctcacagaaaatgctggctattacttccgggtttcagctcagaacactttcggcatcagtgaccctctagaagtgtcctcagttgtgatcattaagagtccatttgaaaagccaggtgctcctggcaaaccaactattactgctgtcacaaaagattcttgtgttgtggcctggaagccacctgccagtgatggaggtgcaaagattagaaattactaccttgagaagcgtgagaagaagcagaataaatggatttctgtgacaacagaagaaattcgagaaactgtcttttcagtgaaaaaccttattgaaggtcttgaatacgagtttcgtgtgaaatgtgaaaatctaggtggggaaagtgaatggagtgaaatatcagaacccatcactcccaaatctgatgtcccaattcaggcaccacactttaaagaggaactgagaaatctaaatgtcagatatcagagcaatgctaccttggtctgcaaagtgactggtcatccaaaacctatcgtcaaatggtacagacaaggcaaagaaatcattgcagatggattaaaatataggattcaagaatttaagggtggctaccaccagctcatcattgcaagtgtcacagatgatgatgccacagtttaccaagtcagagctaccaaccaagggggatctgtgtctggcactgcctccttggaagtggaagttccagctaagatacacttacctaaaactcttgaaggcatgggagcagttcatgctctccgaggtgaagtggtcagcatcaagattcctttcagtggcaaaccagatcctgtgatcacctggcagaaaggacaagatctcattgacaataatggccactaccaagttattgtcacaagatccttcacatcacttgttttccccaatggggtagagagaaaagatgctggtttctatgtggtctgtgctaaaaacagatttggaattgatcagaagacagttgaactggatgtggctgatgttcctgacccacccagaggagtcaaagttagtgatgtctcacgagattctgtcaacttaacatggactgagccagcctctgatggtggcagcaaaatcaccaactacattgttgaaaaatgtgcaactactgcagaaagatggctccgtgtaggacaggcccgagaaacacgttataccgtgatcaacttatttggaaaaacaagttaccagttccgggtaatagctgaaaataaatttggtctgagcaagccttcagagccttcagaaccaaccataaccaaagaagataagaccagagctatgaactatgatgaagaggtagatgaaaccagggaagtctccatgactaaagcatctcactcttcaaccaaggaactctatgagaaatatatgattgctgaagatcttgggcgtggtgagtttggaattgtccatcgttgtgttgaaacatcctcaaagaagacatacatggccaaatttgttaaagtcaaagggactgatcaggttttggtaaagaaggaaatttccattctgaatattgctaggcatagaaacatcttacacctccatgaatcatttgaaagcatggaagaattagttatgatctttgagtttatatcaggacttgacatatttgagcgcattaacacaagtgcttttgaacttaatgaaagagaaattgtaagttatgttcaccaggtctgtgaagcacttcagtttttacacagtcataatattggacactttgacattagaccagaaaatatcatttaccaaaccagaagaagctctaccattaaaatcatagaatttggtcaagcccgtcagctgaaaccaggggacaacttcaggcttctattcactgccccagaatactatgcacctgaagtccaccagcatgatgttgtcagcacagccacagacatgtggtcacttggaacactggtatatgtgctattgagtggtatcaacccattcctggctgaaactaaccaacagatcattgagaatatcatgaatgctgaatatactttcgatgaggaagcattcaaagagattagcattgaagccatggattttgttgaccggttgttagtgaaagagaggaaatctcgcatgacagcatcggaggctctccagcacccatggttgaagcagaagatagaaagagtcagtactaaagttatcagaacattaaaacaccggcgttattaccacaccctgatcaagaaagacctcaacatggttgtgtcagcagcccggatctcctgtggtggtgcaattcgatctcagaagggagtgagtgttgctaaagttaaagtggcatccattgaaattggcccagtttctgggcagataatgcatgcagttggtgaagaaggaggacatgtcaaatatgtatgcaaaattgaaaattatgatcagtctacccaagtgacttggtactttggcgtccgacagctggagaacagtgagaaatacgaaatcacctacgaagatggagtggccatcctctatgtcaaagacattaccaaattagatgatggtacctacagatgcaaagtagtcaatgactatggtgaagacagttcttatgcagagctatttgttaaaggtgtgagagaagtctatgactattactgccgtagaaccatgaagaaaattaagcgcagaacagacacaatgagactcctggaaaggccaccagaatttaccctgcctctctataataagacagcttatgtaggtgaaaatgtccggtttg

SEQ ID NO: 1158 - DNA, 3859 bp, Homo sapiens
agccgccgccacccgccgcgcccgacacccgggaggccccgccagcccgcgggagaggcccagcgggagtcgcggaacagcaggcccgagcccaccgcgccgggccccggacgccgcgcggaaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgcaagaaaatccgatttacaagagtcctattaataatttcaagaatccaaactacggacgtaaagctggtctctaaattgccggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcattt

SEQ ID NO: 1159 - DNA, 3614 bp, Homo sapiens
gtccgccaaaacctgcgcggatagggaagaacagcaccccggcgccgattgccgtaccaaacaagcctaacgtccgctgggccccggacgccgcgcggaaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattcatcagatccaaccacagcagttggttttgcgattaagatcaggggagccacagacatttacattaaaattcaagagagctgaagactatcccattgacctctactaccttatggacctgtcttattcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccaccccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagacttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttca

SEQ ID NO: 1160 - DNA, 3778 bp, Homo sapiens
agccgccgccacccgccgcgcccgacacccgggaggccccgccagcccgcgggagaggcccagcgggagtcgcggaacagcaggcccgagcccaccgcgccgggccccggacgccgcgcggaaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcattt

SEQ ID NO: 1161 - DNA, 2533 bp, Homo sapiens
gagccagcccagccgcgttccgaacgcgagggtcgccggcctgggcgctgtcacgtcggggctgccggagctgcgggggaccgggcccgaacggcccctgacacctgcggtctcccgccgggctgggcaagcgcagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatga

SEQ ID NO: 1162 - DNA, 3405 bp, Homo sapiens
cagtttgatgtactaaaggcttctcgattgggagacaggaaacctgggtgtcagtgccgggtctgccactgaatttctgtgtgacctttgtcagagtactgtacttccagagcgttggtttccacatctaccctataaagcagcctgcatgtttctctcattctctcgttcgaggagttggaggatagctgctgcctgatatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaaacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcattt

SEQ ID NO: 1163 - DNA, 3821 bp, Homo sapiens
agccgccgccacccgccgcgcccgacacccgggaggccccgccagcccgcgggagaggcccagcgggagtcgcggaacagcaggcccgagcccaccgcgccgggccccggacgccgcgcggaaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgcctggagtgcagtggtgtgatatcagctcactgcaacctctgacttccagattccagcaattctcctgcctcagcctcccgagtacctgggattacagggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcattt

SEQ ID NO: 1164 - DNA, 3762 bp, Homo sapiens
atgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacggtaagttacaaaacatccaaaaagcaaagtggcttataaagtaaatgtaatactcctaagacttatgtattagctgtcaggctgattattaaagtcctttctaagtattttattcccccaaaagtttcttactcaaggaatttgcatttagtgaaaaacagaaagcatcctaaatatatcccattgaaacaaaacattgattataagcatgtatattctggttactgtggccagtatttttatttctttaatagttttgatcctaaatctgccttttcatctaatgtgaagtagaatcctaaataatgttatctgtgtagcaagctattcaatggaaagctgcttctttctttaaaacaaacaaacaaaaaaaaccttcagtgaaagccagattcaaaaggttatataccaagcttgtccaactcgcagctcgtcggccaggacatgcagcccagaatagctttgaatgtggccccaacacaaatttgtaaactttcttagaaattgtaattattattattatttttttttggtaacttttttttaaagctcatcagctatcgttagtgtattttatgtgtggcccaagacaattcttcttcttccagtgtggcccagggaagccaaaagattggacacccctgctatatactatatgattccatttagaggacattctggaaaagcaaaactgtaggggcaaaaatcagtggttgctaggggctggaatgggggaaagtgttgaccacagaggggcgtaagggatcttccttgggatgatcttgattgtgggtggatttatgtatttgaaaactcacagaactatgtactttaaaaagatgtatgttcctctatgaaaattatatctcagtaaactttggcttataaaaatcttaaaagccctaagtgaccgaaaggttatgttagcattgagtgctttgaaatatggagtcagagggtggggtaaccaaatgttggcctttgtgtattcatcttttgatacaagaaagcaatgccaatcttcagtatttttaaattgtaaatgaattttgtagttagttgcactttactacaatttgcttgggtttttaaaaattatcaattttttaaattacaaatttcagaagggtagaaataaaaaaaaagacatttatagtgttcaaacactataaagggattttttttttctgatgaaatcattagaaactatttcttttactttagcaagaaaatccgatttacaagagtcctattaataatttcaagaatccaaactacggacgtaaagctggtctctaaattgccgttcgtattttgtttcactttctgcctttgcatgtgaacttctatcttttttactgcactgtgtgtcctttatcactattgctgttctttttttaagtctggctttaaatatcgctattgtggctt

SEQ ID NO: 1165 - DNA, 3804 bp, Homo sapiens
agccgccgccacccgccgcgcccgacacccgggaggccccgccagcccgcgggagaggcccagcgggagtcgcggaacagcaggcccgagcccaccgcgccgggccccggacgccgcgcggaaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgcaagaaaatccgatttacaagagtcctattaataatttcaagaatccaaactacggacgtaaagctggtctctaaattgccggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcattt

SEQ ID NO: 1166 - DNA, 3750 bp, Homo sapiens
atgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgcctggagtgcagtggtgtgatatcagctcactgcaacctctgacttccagattccagcaattctcctgcctcagcctcccgagtacctgggattacagggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcattt

SEQ ID NO: 1167 - DNA, 3894 bp, Homo sapiens
agccgccgccacccgccgcgcccgacacccgggaggccccgccagcccgcgggagaggcccagcgggagtcgcggaacagcaggcccgagcccaccgcgccgggccccggacgccgcgcggaaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgtctctctctgtcgcccagcctggagtgcagtggtgtgatatcagctcactgcaacctctgacttccagattccagcaattctcctgcctcagcctcccgagtacctgggattacagggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcattt

SEQ ID NO: 1168 - DNA, 3888 bp, Homo sapiens
agccgccgccacccgccgcgcccgacacccgggaggccccgccagcccgcgggagaggcccagcgggagtcgcggaacagcaggcccgagcccaccgcgccgggccccggacgccgcgcggaaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacggtaagttacaaaacatccaaaaagcaaagtggcttataaagtaaatgtaatactcctaagacttatgtattagctgtcaggctgattattaaagtcctttctaagtattttattcccccaaaagtttcttactcaaggaatttgcatttagtgaaaaacagaaagcatcctaaatatatcccattgaaacaaaacattgattataagcatgtatattctggttactgtggccagtatttttatttctttaatagttttgatcctaaatctgccttttcatctaatgtgaagtagaatcctaaataatgttatctgtgtagcaagctattcaatggaaagctgcttctttctttaaaacaaacaaacaaaaaaaaccttcagtgaaagccagattcaaaaggttatataccaagcttgtccaactcgcagctcgtcggccaggacatgcagcccagaatagctttgaatgtggccccaacacaaatttgtaaactttcttagaaattgtaattattattattatttttttttggtaacttttttttaaagctcatcagctatcgttagtgtattttatgtgtggcccaagacaattcttcttcttccagtgtggcccagggaagccaaaagattggacacccctgctatatactatatgattccatttagaggacattctggaaaagcaaaactgtaggggcaaaaatcagtggttgctaggggctggaatgggggaaagtgttgaccacagaggggcgtaagggatcttccttgggatgatcttgattgtgggtggatttatgtatttgaaaactcacagaactatgtactttaaaaagatgtatgttcctctatgaaaattatatctcagtaaactttggcttataaaaatcttaaaagccctaagtgaccgaaaggttatgttagcattgagtgctttgaaatatggagtcagagggtggggtaaccaaatgttggcctttgtgtattcatcttttgatacaagaaagcaatgccaatcttcagtatttttaaattgtaaatgaattttgtagttagttgcactttactacaatttgcttgggtttttaaaaattatcaattttttaaattacaaatttcagaagggtagaaataaaaaaaaagacatttatagtgttcaaacactataaagggattttttttttctgatgaaatcattagaaactatttcttttactttagcaagaaaatccgatttacaagagtcctattaataatttcaagaatccaaactacggacgtaaagctggtctctaaattgccgttcgtattttgtttcactttctgcctttgcatgtgaacttctatcttttttactgcactgtgtgtcctttatcactattgctgttctttttttaagtctggctttaaatatcgctattgtggctt

SEQ ID NO: 1169 - DNA, 2481 bp, Homo sapiens
atgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgcaagaaaatccgatttacaagagtcctattaataatttcaagaatccaaactacggacgtaaagctggtctctaaattgccggtgaaaatcctatttataagagtgccgtaacaactgtggtcaatccgaagtatgagggaaaatgagta

SEQ ID NO: 1170 - DNA, 2498 bp, Homo sapiens
atgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgcctggagtgcagtggtgtgatatcagctcactgcaacctctgacttccagattccagcaattctcctgcctcagcctcccgagtacctgggattacagggtgaaaatcctatttataagagtgccgtaacaactgtggtcaatccgaagtatgagggaaaatgagta

SEQ ID NO: 1171 - DNA, 3733 bp, Homo sapiens
atgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgcaagaaaatccgatttacaagagtcctattaataatttcaagaatccaaactacggacgtaaagctggtctctaaattgccggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcattt

SEQ ID NO: 1172 - DNA, 3876 bp, Homo sapiens
agccgccgccacccgccgcgcccgacacccgggaggccccgccagcccgcgggagaggcccagcgggagtcgcggaacagcaggcccgagcccaccgcgccgggccccggacgccgcgcggaaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgcctggagtgcagtggtgtgatatcagctcactgcaacctctgacttccagattccagcaattctcctgcctcagcctcccgagtacctgggattacagggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcattt

SEQ ID NO: 1173 - DNA, 3852 bp, Homo sapiens
cagtttgatgtactaaaggcttctcgattgggagacaggaaacctgggtgtcagtgccgggtctgccactgaatttctgtgtgacctttgtcagagtactgtacttccagagcgttggtttccacatctaccctataaagcagcctgcatgtttctctcattctctcgttcgaggagttggaggatagctgctgcctgatatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcattt

SEQ ID NO: 1174 - DNA, 3839 bp, Homo sapiens
agccgccgccacccgccgcgcccgacacccgggaggccccgccagcccgcgggagaggcccagcgggagtcgcggaacagcaggcccgagcccaccgcgccgggccccggacgccgcgcggaaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgtctctctctgtcgcccagcctggagtgcagtggtgtgatatcagctcactgcaacctctgacttccagattccagcaattctcctgcctcagcctcccgagtacctgggattacagggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcattt

SEQ ID NO: 1175 - DNA, 3788 bp, Homo sapiens
gagccagcccagccgcgttccgaacgtgagggtcgccggcctgggcgctgtcacgtcggggctgccggagctgcgggggaccgggcccgaacggcccctgacacctgcggtctcccgccgggctgggcaagcgcagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcattt

SEQ ID NO: 1176 - DNA, 3670 bp, Homo sapiens
agccgccgccacccgccgcgcccgacacccgggaggccccgccagcccgcgggagaggcccagcgggagtcgcggaacagcaggcccgagcccaccgcgccgggccccggacgccgcgcggaaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggatgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcattt

SEQ ID NO: 1177 - DNA, 3399 bp, Homo sapiens
atgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacggtaagttacaaaacatccaaaaagcaaagtggcttataaagtaaatgtaatactcctaagacttatgtattagctgtcaggctgattattaaagtcctttctaagtattttattcccccaaaagtttcttactcaaggaatttgcatttagtgaaaaacagaaagcatcctaaatatatcccattgaaacaaaacattgattataagcatgtatattctggttcatgtggccgatatttttatttctttaatgattttgatcctaaatctgccttttcatctaatgtgaagtagaatcctaaataatgttatctgtgtagcaagctattcaatgggaaagctgcttctttctttaaaacaaacaaacaaaaaaaaccttcagtggaaagccaaattccaaaaggttatataccaagcttgtccaactcgcagctcgtcggccaggacatgcagcccagaatagctttgaatgtggccccaacacaaatttgtaaactttcttagaaattgtaattattattattatttttttttggtaactttttttaaagctcatcagctatcgttagtgtattttatgtgtggcccaagacagttcttcttcttgccagtgtggcccagggaagccaaaagattggacacccctgctatatactatatgattccatttagaggacattctggaaaagcaaaactgtaggggcaaaaatcagtggttgctaggggctggaatgggggaaagtgttgaccacagaggggcgtaagggatcttccttgggatgacttgattgtgggtggatttatgtatttgaaaactcacagaactatgtactttaaaaagatgtatgttcctctatgaaaattatatctcagtaaactttggcttataaaaatcttaaaagccctaagtgaccgaaaggttatgttagcattgagtgctttgaaatatggagtcagagggtggggtaaccaaatgttggcctttgtgtattcatcttttgatacaagaaagcaatgccaatcttcagtatttttaaattgtaaatgaattttgtagttcccgaattc

SEQ ID NO: 1178 - DNA, 3850 bp, Homo sapiens
agccgccgccacccgccgcgcccgacacccgggaggccccgccagcccgcgggagaggcccagcgggagtcgcggaacagcaggcccgagcccaccgcgccgggccccggacgccgcgcggaaaagatgaatttacaaccaattttctggattggactgatcagttcagtttgctgtgtgtttgctcaaacagattttctataagaagcatatgctggttttataatctcagaaaagatacgttggagacagtctgtattagcgcttaccatgtagaaggcatactcttccttagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaagtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgcaagaaaatccgatttacaagagtcctattaataatttcaagaatccaaactacggacgtaaagctggtctctaaattgccggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcattt

SEQ ID NO: 1179 - DNA, 3768 bp, Homo sapiens
atgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgtctctctctgtcgcccagcctggagtgcagtggtgtgatatcagctcactgcaacctctgacttccagattccagcaattctcctgcctcagcctcccgagtacctgggattacagggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcattt

SEQ ID NO: 1180 - DNA, 2516 bp, Homo sapiens
atgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgtctctctctgtcgcccagcctggagtgcagtggtgtgatatcagctcactgcaacctctgacttccagattccagcaattctcctgcctcagcctcccgagtacctgggattacagggtgaaaatcctatttataagagtgccgtaacaactgtggtcaatccgaagtatgagggaaaatgagta

SEQ ID NO: 1181 - DNA, 2709 bp, Homo sapiens
atgcttgagttcttcacaagtctcacgtcacttagcgacggtcgggaactcctcagtggtagtttcgggagccattcattcattttattcatttcatcattctttcaacagtcataacgtaggtgacgacgactgactcatctcttaaaagatgtgtgtgtccctcgacaaataacctgtctgcccctatcgttctgtaggaggacggagtcccagagaactacaactcccatcaagcacttgggggatcgccgcggctgagggagagactatggcttaggaaccaccattcgcgtgaggctctgctccccgcgcctgcgcagagtgcagggccacgtcgcttttgctgtaccggggaccacgcgtctcatccatggcttccgcggactcgcgccgggtggcagatggcggcggtgccgggggcaccttccagccctacctagacaccttgcggcaggagctgcagcagacggacccaacgctgttgtcagtagtggtggcggttcttgcggtgctgctgacgctagtcttctggaagttaatccggagcagaaggagcagtcagagagctgttcttcttgttggcctttgtgattccgggaaaacgttgctctttgtcaggttgttaacaggcctttatagagacactcagacgtccattactgacagctgtgctgtatacagagtcaacaataacaggggcaatagtctgaccttgattgaccttcccggccatgagagtttgaggcttcagttcttagagcggtttaagtcttcagccagggctattgtgtttgttgtggatagtgcagcattccagcgagaggtgaaagatgtggctgagtttctgtatcaagtcctcattgacagtatgggtctgaagaatacaccatcattcttaatagcctgcaataagcaagatattgcaatggcaaaatcagcaaagttaattcaacagcagctggagaaagaactcaacaccttacgagttacccgttctgctgcccccagcacactggacagttccagcactgcccctgctcagctggggaagaaaggcaaagagtttgaattctcacagttgcccctcaaagtggagttcctggagtgcagtgccaagggtggaagaggggacgtgggctctgctgacatccaggacttggagaaatggctggctaaaattgcctgagaggcagctctaaagcacaagacctggatgtgtgacacacagttttggaaaaaggtctgtggtagtctggagttgatgaggaaggggtacaagatgtggttagaaacatttctttgttctggaaacaaagtactgttgaaaccagcttggaattttttttttttttttttttaagttcagttctcccttatggctgcctttcaaacaagtaccttttatctgatgcctgtatcttccctttgttaaggtgtaacttgatgtagggtcaaggtttttgtgacaacaggcagactccacacagagaggatatgatgagaatatggccatcacctgaaaagttttcttatcttctgtgcttttggtccctggaaacaaatccgcctatgtatgaagctagttgatttccagttgcactatttccagttgcctctgaagttcacaggcaatacattgtctagtcctttgcgaatttctctgatttgtgggcacagttatgaagtttccccacatgtgaagacaggtacaaaatagcagagccaagcagacagtgggtctattcttcattagctcagtgacttgtccacactcgtcttagcacttacgtttcaaaagcttgtcacaaacccttggagtcattcccagataatagaactggaaatgataaatcccctaatgccaagggtctagtgtgttcttagtggttatactgggaagtgtgtggagatttaggtgctgctctgctgctctggatggctgaaggctcctgggccatcttcatgtgctgcttgaagagctcctattttgtactcctggctagaatgctgtggaacaaatacaaagtgaaaaaagttctctgtagatttctgaagtgcatattcattgatgccaagaaaaaaaaaaagttgcctttttgaagtgatgttttttgctgtcttcttaaacacaaggcttttttgaatgattagtatatttcatggtaaagaaaacagcctgtctggctcaaagcaattaaatagaatgtaatggtgagtacaaatgagtgcacatgtcaggactcaggtctaactccttgtctcctgagcctaaagattgcaacatacacaagaacacactcctattcctaccccacacactcagggacaagcccaactaaagcttacaaggagaccagggtggctctgtccaggggcctctgcctgctgtctcacatgtcccttctggtggtcacttgggctctaggagtatacgtcacctcagaccatctggcagaaatactccaggctcctaccccaaagcacatgtcagccttgctgctggagcacgaagacaatgtaaatgaaacatgaaatggaggagttgtgagaccctgaccctgagtccttacttgaaagctgctgctggtgttctgagtgtcttttggactcttatttcttgcccttttccttattaggcaagcagtaacttaggaagtaggtaagagcaataaatgtgacatgttatgtcatcatagtaggagctca

SEQ ID NO: 1182 - DNA, 975 bp, Homo sapiens
atgcttgagttcttcacaagtctcacgtcacttagcgacggtcgggaactcctcagtggtagtttcgggagccattcattcattttattcatttcatcattctttcaacagtcataacgtaggtgacgacgactgactcatctcttaaaagatgtgtgtgtccctcgacaaataacctgtctgcccctatcgttctgtaggaggacggagtcccagagaactacaactcccatcaagcacttgggggatcgccgcggctgagggagagactatggcttaggaaccaccattcgcgtgaggctctgctccccgcgcctgcgcagagtgcagggccacgtcgcttttgctgtaccggggaccacgcgtctcatccatggcttccgcggactcgcgccgggtggcagatggcggcggtgccgggggcaccttccagccctacctagacaccttgcggcaggagctgcagcagacggacccaacgctgttgtcagtagtggtggcggttcttgcggtgctgctgacgctagtcttctggaagttaatccggagcagaaggagcagtcagagagctgttcttcttgttggcctttgtgattccgggaaaacgttgctctttgtcaggttgttaacaggcctttatagagacactcagacgtccattactgacagctgtgctgtatacagagtcaacaataacaggggcaatagtctgaccttgattgaccttcccggccatgagagtttgaggcttcagttcttagagcggtttaagtcttcagccagggctattgtgtttgttgtggatagtgcagcattccagcgagaggtgaaagatgtggctgagtttctgtatcaagtcctcattgacagtatgggtctgaagaatacaccatcattcttaatagcctgcaataagcaagatattgcaatggcaaaatcagcaaagttaattcaacagcagctggagaaagaact

SEQ ID NO: 1183 - DNA, 2916 bp, Homo sapiens
atgcttgagttcttcacaagtctcacgtcacttagcgacggtcgggaactcctcagtggtagtttcgggagccattcattcattttattcatttcatcattctttcaacagtcataacgtaggtgacgacgactgactcatctcttaaaagatgtgtgtgtccctcgacaaataacctgtctgcccctatcgttctgtaggaggacggagtcccagagaactacaactcccatcaagcacttgggggatcgccgcggctgagggagagactatggcttaggaaccaccattcgcgtgaggctctgctccccgcgcctgcgcagagtgcagggccacgtcgcttttgctgtaccggggaccacgcgtctcatccatggcttccgcggactcgcgccgggtggcagatggcggcggtgccgggggcaccttccagccctacctagacaccttgcggcaggagctgcagcagacggacccaacgctgttgtcagtagtggtggcggttcttgcggtgctgctgacgctagtcttctggaagttaatccggagcagaaggagcagtcagagagctgttcttcttgttggcctttgtgattccgggaaaacgttgctctttgtcaggttgttaacaggcctttatagagacactcagacgtccattactgacagctgtgctgtatacagagtcaacaataacaggggcaatagtctgaccttgattgaccttcccggccatgagagtttgaggcttcagttcttagagcggtttaagtcttcagccagggctattgtgtttgttgtggatagtgcagcattccagcgagaggtgaaagatgtggctgagtttctgtatcaagtcctcattgacagtatgggtctgaagaatacaccatcattcttaatagcctgcaataagcaagatattgcaatggcaaaatcagcaaagttaattcaacagcagctggagaaagaactcaacaccttacgagttacccgttctgctgcccccagcacactggacagttccagcactgcccctgctcagctggggaagaaaggcaaagagtttgaattctcacagttgcccctcaaagtggagttcctggagtgcagtgccaagggtggaagaggggacgtgggctctgctgacatccaggacttggagaaatggctggctaaaattgcctgagaggcagctctaaagcacaagacctggatgtgtgacacacagttttggaaaaaggtctgtggtagtctggagttgatgaggaaggggtacaagatgtggttagaaacatttctttgttctggaaacaaagtactgttgaaaccagcttggaattttttttttttttttttttaagttcagttctcccttatggctgcctttcaaacaagtaccttttatctgatgcctgtatcttccctttgttaaggtgtaacttgatgtagggtcaaggtttttgtgacaacaggcagactccacacagagaggatatgatgagaatatggccatcacctgaaaagttttcttatcttctgtgcttttggtccctggaaacaaatccgcctatgtatgaagctagttgatttccagttgcactatttccagttgcctctgaagttcacaggcaatacattgtctagtcctttgcgaatttctctgatttgtgggcacagttatgaagtttccccacatgtgaagacaggtacaaaatagcagagccaagcagacagtgggtctattcttcattagctcagtgacttgtccacactcgtcttagcacttacgtttcaaaagcttgtcacaaacccttggagtcattcccagataatagaactggaaatgataaatcccctaatgccaagggtctagtgtgttcttagtggttatactgggaagtgtgtggagatttaggtgctgctctgctgctctggatggctgaaggctcctgggccatcttcatgtgctgcttgaagagctcctattttgtactcctggctagaatgctgtggaacaaatacaaagtgaaaaaagttctctgtagatttctgaagtgcatattcattgatgccaagaaaaaaaaaaagttgcctttttgaagtgatgttttttgctgtcttcttaaacacaaggcttttttgaatgattagtatatttcatggtaaagaaaacagcctgtctggctcaaagcaattaaatagaatgtaatggtgagtacaaatgagtgcacatgtcaggactcaggtctaactccttgtctcctgagcctaaagattgcaacatacacaagaacacactcctattcctaccccacacactcagggacaagcccaactaaagcttacaaggagaccagggtggctctgtccaggggagaagccagttatggaacagtgcattgagagccatggtaggagaggcccacagttctctggagcatgcagcaggggcaccccacctggccttgaggatcagggggagtcaaaggataaagcatggggctgatgacgtctgagggagtgtgatcctccatgtatggcctctgcctgctgtctcacatgtcccttctggtggtcacttgggctctaggagtatacgtcacctcagaccatctggcagaaatactccaggctcctaccccaaagcacatgtcagccttgctgctggagcacgaagacaatgtaaatgaaacatgaaatggaggagttgtgagaccctgaccctgagtccttacttgaaagctgctgctggtgttctgagtgtcttttggactcttatttcttgcccttttccttattaggcaagcagtaacttaggaagtaggtaagagcaataaatgtgacatgttatgtcatcatagtaggagctcatgggaataaaagtcagtggcttgatgcttctgttagaggcat

SEQ ID NO: 1184 - DNA, 1745 bp, Homo sapiens
accacgcgtctcatccatggcttccgcggactcgcgccgggtggcagatggcggcggtgccgggggcaccttccagccctacctagacaccttgcggcaggagctgcagcagacggacccaacgctgttgtcagtagtggtggcggttcttgcggtgctgctgacgctagtcttctggaagttaatccggagcagaaggagcagtcagagagctgttcttcttgttggcctttgtgattccgggaaaacgttgctctttgtcaggttgttaacaggcctttatagagacactcagacgtccattactgacagctgtgctgtatacagagtcaacaataacaggggcaatagtctgaccttgattgaccttcccggccatgagagtttgaggcttcagttcttagagcggtttaagtcttcagccagggctattgtgtttgttgtggatagtgcagcattccagcgagaggtgaaagatgtggctgagtttctgtatcaagtcctcattgacagtatgggtctgaagaatacaccatcattcttaatagcctgcaataagcaagatattgcaatggcaaaatcagcaaagttaattcaacagcagctggagaaagaactcaacaccttacgagttacccgttctgctgcccccagcacactggacagttccagcactgcccctgctcagctggggaagaaaggcaaagagtttgaattctcacagttgcccctcaaagtggagttcctggagtgcagtgccaagggtggaagaggggacgtgggctctgctgacatccaggacttggagaaatggctggctaaaattgcctgagaggcagctctaaagcacaagacctggatgtgtgacacacagttttggaaaaaggtctgtggtagtctggagttgatgaggaaggggtacaagatgtggttagaaacatttctttgttctggaaacaaagtactgttgaaaccagcttggaattttttttttttttttttttaagttcagttctcccttatggctgcctttcaaacaagtaccttttatctgatgcctgtatcttccctttgttaaggtgtaacttgatgtagggtcaaggtttttgtgacaacaggcagactccacacagagaggatatgatgagaatatggccatcacctgaaaagttttcttatcttctgtgcttttggtccctggaaacaaatccgcctatgtatgaagctagttgatttccagttgcactatttccagttgcctctgaagttcacaggcaatacattgtctagtcctttgcgaatttctctgatttgtgggcacagttatgaagtttccccacatgtgaagacaggtacaaaatagcagagccaagcagacagtgggtctattcttcattagctcagtgacttgtccacactcgtcttagcacttacgtttcaaaagcttgtcacaaacccttggagtcattcccagataatagaactggaaatgataaatcccctaatgccaagggtctagtgtgttcttagtggttatactgggaagtgtgtggagatttaggtgctgctctgctgctctggatggctgaaggctcctgggccatcttcatgtgctgcttgaagagctcctattttgtactcctggctagaatgctgtggaacaaatacaaagtgaaaaaagttctctgtagatttctgaagtgcatattcattgatgccaagaaaaaaaaaaagttgcctttttg

SEQ ID NO: 1185 - DNA, 4352 bp, Homo sapiens
gcttttcgcttcgcgtggggtgagagcggagcggtggcgatttggggtttggtggcaagcgagggttgggacgggctgggctcagtttttcctggtccggtggaggttctcctgggatcacgcgaaggcggcggccgaggttggctactgagtgcaggagctgcggaggcgcgagcagcgtcttctggtgctgccgttcttagccggtccttcagtagcctgacctgagtgttagtgcttcagaggaacaaaccagtagaccagaacttggtcaggaagtttcaggaagctattggagcagtgttgggatttcccaccaggatgactatgattggctgtgattttagatcttaaatcagaaaactgaaaacatgaaagtagacaggactaaactgaaaaagacacctactgaagctgtggggattgcccttccaagcattaaggcaaaggacaaaataccaaaatggaaatgtaaaataccatatccaaaataaaaggacacatgacaatagccattctaacagcctgcagactgcagagccttaatagacaaactcaaagtttgtaatgatgagcaactcctcttggaactgcagcaaatcaaaacatggaacattggcaagtgtgagttatatcactgggtggatctgttggaccgctttgatggaattctggcagatgctggacaaacagtggagaatatgtcatggatgcttgtatgtgataggccagaaaaagaacagctgaaaatgcttctattggctgtattgaacttcacagccttgctcattgagtacagcttttctcggcatctgtacagttccatagagcatttgacaactttattggcttcctctgatatgcaagtggtgctggcagtccttaaccttctatatgtatttagcaaaagatcaaactatatcacacgtcttggatctgacaagaggactccgctactgacacggctgcagcatttggcagagagctggggtggaaaggagaatggctttggacttgcagaatgttgcagagacttgcaaatgttgaaatatccacccagtgcaaccacactacactttgaattttatgcagatcctggagctgaggtcaaaattgagaagaggacaactagtaatacactacattatattcacatagaacaacttgacaagatttcagaaagtccttctgaaataatggaatctcttaccaaaatgtacagcattcctaaggataagcagatgctgttatttacacatatacgactggcccatggcttttctaatcacaggaagcggttacaagctgttcaggccagactgcatgcaatatctatattagtctattctaatgccttgcaagagtcagcaaacagtatcttgtataatgggttgatagaggagttggtagatgtccttcaaataacagataagcagctcatggaaattaaagctgcttctttacgaacgttaacatcaattgttcatttggagagaactcccaagctcagcagtattattgactgtactggaactgcctcctaccatggatttttgcctgtacttgtgcggaactgcattcaggccatgattgatccttccatggacccatacccccatcagtttgccacagctcttttctcctttttgtaccatctggctagctacgatgctggtggtgaagccttggtctcctgtggaatgatggaagccttactaaaggtcataaagtttcttggtgatgaacaagaccagataacatttgtaaccagagctgtcagagtggttgaccttatcaccaacctggacatggcagcttttcagtctcatagtggtctttctatcttcatctatagacttgagcacgaagtagatttgtgtcgtaaagaatgccctttcgtgatcaagccaaagatccagagacccagtaccactcaagaaggagaagaaatggaaactgatatggatggagttcagtgtattccacaacgagcagcacttctcaagtccatgttgaatttcctcaagaaggccattcaagaccctgctttctcagatggcatacgacatgtgatggatggttctttacctacctctctgaaacacatcatcagcaatgcagaatactatggtccatcactcttcctcctagctactgaagtggtgactgtgtttgtatttcaagagccatcactgctgtcctcactccaggacaatggactgacagatgtcatgctgcatgcactgctcatcaaagatgttcctgctacaagggaagtcctcggttccctcccaaatgtattcagtgcactttgcttgaatgcccgaggtcttcagtcttttgtacaatgtcagccatttgaacgtctcttcaaagttcttctgtctcctgattacctcccagccatgcggaggaggaggagttctgatccccttggggatactgcatccaacctggggagtgctgttgatgagctcatgagacaccagcctaccctcaaaacagatgcaacaactgccatcatcaagttacttgaagaaatctgtaatcttggaagagatcctaaatacatttgtcagaagccatctattcagaaagcggatggtactgctactgctcctcctccaaggtctaatcatgctgcagaagaggcttccagtgaagatgaggaggaagaggaagtacaggccatgcagagctttaattctgcccagcagaatgaaactgagcctaatcagcaggtcgttggtaccgaggaacgtatacctatacccctcatggattacatccttaatgtgatgaaatttgtggaatctattttgagcaacaatacaacagatgaccactgtcaagaatttgtaaaccagaaaggactcttacctttggttaccattttgggtcttcccaatctgcccattgactttcccacatctgctgcctgtcaggctgttgcaggtgtctgcaaatccatattggtaagaaacatctagcgaaatattttacatctctgtatgtattttcattgtgttctcgcttaaggacctctagttaaaaattgataaatttgtgtgttttatattttatactatttcccatagtaaaattatttattttctttgtttttgcatttgcgtgtagttttgccatttgaattcatatgcgtctaaattatttccaggaaagctttctagctttcttcatgttgttatggtactgtttttttgttttaatatgcgcattcactttgcagtgttcgttccttttccccaagctttattagtcataaattgatatgtaatttattgcttaaaatttgccaaaaacagtttctttatttctacaacacctttgatttttgcaagttacttgttcacccctaatgccttcagttagtaattatcattctatttactcaacttgaaagtaccttatgtaatagcattgtatagcatttaagagtgttacagtgacactaaatatttattaattttgtcagtttcctttttaaagctaaatgataaaaaaaaacacaagaaaagctaaatgatattttatgaaatacactctagatcattttgtccgttcctctgttactggacactgaggttgcttttattttagcccctgatgaatactgttataaacttgagtgtataaatagcacttcaagatttgccttttgaatcttttggatatatactttgaagtgacataacttaatcaaatgataattctatttgtgtgtgtgtgtgcttgcatgaaaccttcaaagtacttttccaagattattttccattcctagttagcgccacataaggattgtaatttcaccatttccatgccagatcggtcggtcggtcggtcggtctgtctttctttctttctttctttctttctttctttctttctttctttctttctttctttccttctttccttccttccttccttccttccttccttccttccttccttctttctttctttctttctttctttctttctttctttctttctttctttctgttttcttaaataatagccatccttgaagataaagtagtgcttcgttttcattttgacttgcatttcctaaataattggtggtattgatcataacgtttgatttgtgtacttgagttattgtctatgtgtgcatcctttgctaaacgaatacttgtgttctttattttatatttaatcaaattaagatgtttttctgttcattatcgaatatctctgtatatattgaacaccagcctctttttttcagatacatcacttgcaaatatcctcattttgtcagttgcctgtttgttaccattgacatactaaaggttttgatgctgacc

SEQ ID NO: 1186 - DNA, 4544 bp, Homo sapiens
caggtttattcagtcaccatgaagctgctgctgctgcacccggccttccagagctgcctcctgctgaccctgcttggcttatggagaaccacccctgaggctcacgcttcatccctgggtgcaccagctatcagcgctgcctccttcctgcaggatctaatacatcggtatggcgagggtgacagcctcactctgcagcagctgaaggccctactcaaccacctggatgtgggagtgggccggggtaatgtcacccagcacgtgcaaggacacaggaacctctccacgtgctttagttctggagacctcttcactgcccacaatttcagcgagcagtcgcggattgggagcagcgagctccaggagttctgccccaccatcctccagcagctggattcccgggcctgcacctcggagaaccaggaaaacgaggagaatgagcagacggaggaggggcggccaagcgctgttgaagtgtggggctttggttttctcagtgtctcactgattaacctggcctctctcctgggagtcctcgtcctgccctgcacagagaaagcgtttttcagccgtgtgctcacttacttcatcgccctgtccattggaacgctgctgtctaacgcgctattccagctcatcccagaggcatttggtttcaaccctctggaagattattatgtctccaagtctgcagtggtgtttgggggcttttatcttttctttttcacagagaagatcttgaagattcttcttaagcagaaaaatgagcatcatcatggacacagccattatgcctctgagtcgcttccctccaagaaggaccaggaggagggggtgatggagaagctgcagaacggggacctggaccacatgattcctcagcactgcagcagtgagctggacggcaaggcgcccatggtggacgagaaggtcattgtgggctcgctctctgtgcaggacctgcaggcttcccagagtgcttgctactggctgaaaggtgtccgctactctgatatcggcactctggcctggatgatcactctgagcgacggcctccataatttcatcgatggcctggccatcggtgcttccttcactgtgtcagttttccaaggcatcagcacctcggtggccatcctctgtgaggagttcccacatgagctaggagactttgtcatcctgctcaacgctgggatgagcatccaacaagctctcttcttcaacttcctttctgcctgctgctgctacctgggtctggcctttggcatcctggccggcagccacttctctgccaactggatttttgcgctagctggaggaatgttcttgtatatttctctggctgatatgttccctgagatgaatgaggtctgtcaagaggatgaaaggaagggcagcatcttgattccatttatcatccagaacctgggcctcctgactggattcaccatcatggtggtcctcaccatgtattcaggacagatccagattgggtagggctctgccaagagcctgtgggactggaagtcgggccctgggctgcccgatcgccagcccgaggacttaccatccacaatgcaccacggaagaggccgttctatgaaaaactgacacagactgtattcctgcattcaaatgtcagccgtttgtaaaatgctgtatcctaggaataagctgccctggtaaccagtctctagctagtgcctcttgccctctcctcacctccttttctctcagtgactctggaacctgaatgcagcttacaagacaagcctgacttttttctctgattaccttggcctcctcttggaaccagtgctgaaaggttttgaatcctttacccaacaatgcaaaaatagagccaatggttataacttggctagaaatatcaagagttgaatccatagtgtggggcccatgactctagctgggcaccttggacctccagctggccaatagaagagacaggagacaggaagccttcccattttttcaaagtctgtttaattgcctattacttctctcaaagagaacctgaagtcagaacacatgagcagggtgagaggtgaggcaaggttcatcctgaatgggagaggaagtcgaaccactgctgtgtgtcttgtcaggatgctcacttgttcctactgagatgctggatattgattttgtaacagcacctggtgtttcacggctgtccgagtgagctaacgtggcggtgtggctgcctggacctcctctttcaggttaacgctgacagaatggaggctcaggctgtctgcaagaaaacagttggtttggctgtgattttgacctcctcttccccactgccatcttctaagagactttgtagctgcctcctagaagcacattctgagcacatttgagacctctgtgttagaggggagactgcacaaactatcctcccccaggttgagacgtctgcagagtggcaagctgacttgtagaaatggggtgccatttatgctctacttagacaagggtaatcagaaatggaatcagtgcaggcaaaatttaggatttgccgcttccataaatcaaagcatgactaatagggggtctctgaaatgtaagggcacaaacttcacttagggcatcgcagatgtttgcagaatggttggcctaatgattatgctacagatgggttttaaatgacccgtctaggttactgcttccttgcaaaaaaagtcgaatcctgcattgaattgaatatgaatttctctaactctctccagaaaatggatggagataacttgtctttaaaactgtaggccagccttagccactgtggagcccttgcctccgagctctggcttcaaggggagctcttctccaggttcactaggtgaattgatttattattatcatattgataatgtgagattctttagccactttggggagcctgtctctccagaagcctttcttagtggtgcccacagttggagcccaggggccatgtttgcaaactgattcatgtgcatggctgacaggagtactggttcactaccaatgcctgagcttttctcttacatagaaaaactgtccactctcagtaatcacaagcagcatccgttttgttttctcttcttgggagacatctgtcaaaccaggaatattcttgaaaagaacgtgagcaggaaaaactgctggtgatactttttttaagttttgtttttatcttgcctgttggcttcaatacatttgagaatacgctgaagagggaaaatttcagtgatggagattctagattaaatatcaggactgatttcctggtgggaggattatggtccagttttaccaaagaaccaattccttgaatgttggaatctaactttttatattgtcattattattgttgtttttaaacggttctttgtcttttctgttttatttttctcaagctgctttcaggagctagcagaaaataactcaaagttgaagactctggaagattttgctttaacctaactcgcattgatgtattaaatttataattttagcattcccaatagatcctatcattccttaaacataataccctttgtcttggagtagaatactaagttagagttagtggatttctagtttaggagaggagctcaaaactataatctttaacaaattgaaaaatgaaatagggtgttttccctttttgtgcacacctatattaccttaagaaatttccttccatagacagctgcctcaaagggaaatcctctttaaaccgtagttggcgcagaggtcagtcctagtcggagcttaggaggggcggagacgctcacatcgtctgacttgagtcgccactgattgtggcaacagctttgcctcatgagtcaaaaattggcaatttcttttgatttttagttgttgaatttgctgtttcaagcatttgtacatattagaagtctaaggagtagcaagtcagtgggaggactttttcacccctggcattagcagcttcgacctcattttccagatgcaccagctcctattaataagttagcaaggaaagtgtatgtcacgtgcaggaacagtgaggcagggacaggggttctgctccttctcacttcaccaccggcacacagcttgcccctgtctttgcccccaaaggtattttgtgtctagtgtcacattggagctattcttcactggtccttaaccttgggttttaaaaagaaggcttctctgtttgggtagcgtaagagctgagtatagtaagtcctcttccaaagagatggcaatatgctgggcatctactttaaaacaaagttgtctgatttttgcaagagaggttaggattttattgttcttatttccctttacagttctgcagttccatcacagtatttttttaaataactcaggtgtatgagaagaaattagaaaagaaaattaacttatgtggactgtaaatgttttatttgtaagattctataaataaagctatattctgtaattgttgagaatcccacgggtgatcatttgcaataaatgtggatgtaatgaaggctgttgaacacaag

SEQ ID NO: 1187 - DNA, 4544 bp, Homo sapiens
caggtttattcagtcaccatgaagctgctgctgctgcacccggccttccagagctgcctcctgctgaccctgcttggcttatggagaaccacccctgaggctcacgcttcatccctgggtgcaccagctatcagcgctgcctccttcctgcaggatctaatacatcggtatggcgagggtgacagcctcactctgcagcagctgaaggccctactcaaccacctggatgtgggagtgggccggggtaatgtcacccagcacgtgcaaggacacaggaacctctccacgtgctttagttctggagacctcttcactgcccacaatttcagcgagcagtcgcggattgggagcagcgagctccaggagttctgccccaccatcctccagcagctggattcccgggcctgcacctcggagaaccaggaaaacgaggagaatgagcagacggaggaggggcggccaagcgctgttgaagtgtggggatacggtctcctctgtgtgaccgtcatctccctctgctccctcctgggggccagcgtggtgcccttcatgaagaagaccttttacaagaggctgctgctctacttcatagctctggcgattggaaccctctactccaacgccctcttccagctcatcccggaggcatttggtttcaaccctctggaagattattatgtctccaagtctgcagtggtgtttgggggcttttatcttttctttttcacagagaagatcttgaagattcttcttaagcagaaaaatgagcatcatcatggacacagccattatgcctctgagtcgcttccctccaagaaggaccaggaggagggggtgatggagaagctgcagaacggggacctggaccacatgattcctcagcactgcagcagtgagctggacggcaaggcgcccatggtggacgagaaggtcattgtgggctcgctctctgtgcaggacctgcaggcttcccagagtgcttgctactggctgaaaggtgtccgctactctgatatcggcactctggcctggatgatcactctgagcgacggcctccataatttcatcgatggcctggccatcggtgcttccttcactgtgtcagttttccaaggcatcagcacctcggtggccatcctctgtgaggagttcccacatgagctaggagactttgtcatcctgctcaacgctgggatgagcatccaacaagctctcttcttcaacttcctttctgcctgctgctgctacctgggtctggcctttggcatcctggccggcagccacttctctgccaactggatttttgcgctagctggaggaatgttcttgtatatttctctggctgatatgttccctgagatgaatgaggtctgtcaagaggatgaaaggaagggcagcatcttgattccatttatcatccagaacctgggcctcctgactggattcaccatcatggtggtcctcaccatgtattcaggacagatccagattgggtagggctctgccaagagcctgtgggactggaagtcgggccctgggctgcccgatcgccagcccgaggacttaccatccacaatgcaccacggaagaggccgttctatgaaaaactgacacagactgtattcctgcattcaaatgtcagccgtttgtaaaatgctgtatcctaggaataagctgccctggtaaccagtctctagctagtgcctcttgccctctcctcacctccttttctctcagtgactctggaacctgaatgcagcttacaagacaagcctgacttttttctctgattaccttggcctcctcttggaaccagtgctgaaaggttttgaatcctttacccaacaatgcaaaaatagagccaatggttataacttggctagaaatatcaagagttgaatccatagtgtggggcccatgactctagctgggcaccttggacctccagctggccaatagaagagacaggagacaggaagccttcccattttttcaaagtctgtttaattgcctattacttctctcaaagagaacctgaagtcagaacacatgagcagggtgagaggtgaggcaaggttcatcctgaatgggagaggaagtcgaaccactgctgtgtgtcttgtcaggatgctcacttgttcctactgagatgctggatattgattttgtaacagcacctggtgtttcacggctgtccgagtgagctaacgtggcggtgtggctgcctggacctcctctttcaggttaacgctgacagaatggaggctcaggctgtctgcaagaaaacagttggtttggctgtgattttgacctcctcttccccactgccatcttctaagagactttgtagctgcctcctagaagcacattctgagcacatttgagacctctgtgttagaggggagactgcacaaactatcctcccccaggttgagacgtctgcagagtggcaagctgacttgtagaaatggggtgccatttatgctctacttagacaagggtaatcagaaatggaatcagtgcaggcaaaatttaggatttgccgcttccataaatcaaagcatgactaatagggggtctctgaaatgtaagggcacaaacttcacttagggcatcgcagatgtttgcagaatggttggcctaatgattatgctacagatgggttttaaatgacccgtctaggttactgcttccttgcaaaaaaagtcgaatcctgcattgaattgaatatgaatttctctaactctctccagaaaatggatggagataacttgtctttaaaactgtaggccagccttagccactgtggagcccttgcctccgagctctggcttcaaggggagctcttctccaggttcactaggtgaattgatttattattatcatattgataatgtgagattctttagccactttggggagcctgtctctccagaagcctttcttagtggtgcccacagttggagcccaggggccatgtttgcaaactgattcatgtgcatggctgacaggagtactggttcactaccaatgcctgagcttttctcttacatagaaaaactgtccactctcagtaatcacaagcagcatccgttttgttttctcttcttgggagacatctgtcaaaccaggaatattcttgaaaagaacgtgagcaggaaaaactgctggtgatactttttttaagttttgtttttatcttgcctgttggcttcaatacatttgagaatacgctgaagagggaaaatttcagtgatggagattctagattaaatatcaggactgatttcctggtgggaggattatggtccagttttaccaaagaaccaattccttgaatgttggaatctaactttttatattgtcattattattgttgtttttaaacggttctttgtcttttctgttttatttttctcaagctgctttcaggagctagcagaaaataactcaaagttgaagactctggaagattttgctttaacctaactcgcattgatgtattaaatttataattttagcattcccaatagatcctatcattccttaaacataataccctttgtcttggagtagaatactaagttagagttagtggatttctagtttaggagaggagctcaaaactataatctttaacaaattgaaaaatgaaatagggtgttttccctttttgtgcacacctatattaccttaagaaatttccttccatagacagctgcctcaaagggaaatcctctttaaaccgtagttggcgcagaggtcagtcctagtcggagcttaggaggggcggagacgctcacatcgtctgacttgagtcgccactgattgtggcaacagctttgcctcatgagtcaaaaattggcaatttcttttgatttttagttgttgaatttgctgtttcaagcatttgtacatattagaagtctaaggagtagcaagtcagtgggaggactttttcacccctggcattagcagcttcgacctcattttccagatgcaccagctcctattaataagttagcaaggaaagtgtatgtcacgtgcaggaacagtgaggcagggacaggggttctgctccttctcacttcaccaccggcacacagcttgcccctgtctttgcccccaaaggtattttgtgtctagtgtcacattggagctattcttcactggtccttaaccttgggttttaaaaagaaggcttctctgtttgggtagcgtaagagctgagtatagtaagtcctcttccaaagagatggcaatatgctgggcatctactttaaaacaaagttgtctgatttttgcaagagaggttaggattttattgttcttatttccctttacagttctgcagttccatcacagtatttttttaaataactcaggtgtatgagaagaaattagaaaagaaaattaacttatgtggactgtaaatgttttatttgtaagattctataaataaagctatattctgtaattgttgagaatcccacgggtgatcatttgcaataaatgtggatgtaatgaaggctgttgaacacaag

SEQ ID NO: 1188 - DNA, 1461 bp, Homo sapiens
caggtttattcagtcaccatgaagctgctgctgctgcacccggccttccagagctgcctcctgctgaccctgcttggcttatggagaaccacccctgaggctcacgcttcatccctgggtgcaccagctatcagcgctgcctccttcctgcaggatctaatacatcggtatggcgagggtgacagcctcactctgcagcagctgaaggccctactcaaccacctggatgtgggagtgggccggggtaatgtcacccagcacgtgcaaggacacaggaacctctccacgtgctttagttctggagacctcttcactgcccacaatttcagcgagcagtcgcggattgggagcagcgagctccaggagttctgccccaccatcctccagcagctggattcccgggcctgcacctcggagaaccaggaaaacgaggagaatgagcagacggaggaggggcggccaagcgctgttgaagtgtggggatacggtctcctctgtgtgaccgtcatctccctctgctccctcctgggggccagcgtggtgcccttcatgaagaagaccttttacaagaggctgctgctctacttcatagctctggcgattggaaccctctactccaacgccctcttccagctcatcccggaggcatttggtttcaaccctctggaagattattatgtctccaagtctgcagtggtgtttgggggcttttatcttttctttttcacagagaagatcttgaagattcttcttaagcagaaaaatgagcatcatcatggacacagccattatgcctctgagtcgcttccctccaagaaggaccaggaggagggggtgatggagaagctgcagaacggggacctggaccacatgattcctcagcactgcagcagtgagctggacggcaaggcgcccatggtggacgagaaggtcattgtgggctcgctctctgtgcaggacctgcaggcttcccagagtgcttgctactggctgaaaggtgtccgctactctgatatcggcactctggcctggatgatcactctgagcgacggcctccataatttcatcgatggcctggccatcggtgcttccttcactgtgtcagttttccaaggcatcagcacctcggtggccatcctctgtgaggagttcccacatgagctaggagactttgtcatcctgctcaacgctgggatgagcatccaacaagctctcttcttcaacttcctttctgcctgctgctgctacctgggtctggcctttggcatcctggccggcagccacttctctgccaactggatttttgcgctagctggaggaatgttcttgtatatttctctggctgatatgatggagttttgctctgttgcccaggctggagtgcaatggtgccatctcagctcactgcaacctctgccgcttgggttgaagcgattatcctgtctaagcctcccgagtaac

SEQ ID NO: 1189 - DNA, 4649 bp, Homo sapiens
atgggagcgggcgccgaccacagccagggccgcgaggcgcaggagggcgcaggctggccagtgaggggggtcggcgcgcgtgtctacgcggacgcaccggctaagctgcttctgccgccgccggccgcctgggaccttgcggtgaggctgcgcggggccgaggccgcctccgagcgccaggtttattcagtcaccatgaagctgctgctgctgcacccggccttccagagctgcctcctgctgaccctgcttggcttatggagaaccacccctgaggctcacgcttcatccctgggtgcaccagctatcagcgctgcctccttcctgcaggatctaatacatcggtatggcgagggtgacagcctcactctgcagcagctgaaggccctactcaaccacctggatgtgggagtgggccggggtaatgtcacccagcacgtgcaaggacacaggaacctctccacgtgctttagttctggagacctcttcactgcccacaatttcagcgagcagtcgcggattgggagcagcgagctccaggagttctgccccaccatcctccagcagctggattcccgggcctgcacctcggagaaccaggaaaacgaggagaatgagcagacggaggaggggcggccaagcgctgttgaagtgtggggatacggtctcctctgtgtgaccgtcatctccctctgctccctcctgggggccagcgtggtgcccttcatgaagaagaccttttacaagaggctgctgctctacttcatagctctggcgattggaaccctctactccaacgccctcttccagctcatcccggaggcatttggtttcaaccctctggaagattattatgtctccaagtctgcagtggtgtttgggggcttttatcttttctttttcacagagaagatcttgaagattcttcttaagcagaaaaatgagcatcatcatggacacagccattatgcctctgagtcgcttccctccaagaaggaccaggaggagggggtgatggagaagctgcagaacggggacctggaccacatgattcctcagcactgcagcagtgagctggacggcaaggcgcccatggtggacgagaaggtcattgtgggctcgctctctgtgcaggacctgcaggcttcccagagtgcttgctactggctgaaaggtgtccgctactctgatatcggcactctggcctggatgatcactctgagcgacggcctccataatttcatcgatggcctggccatcggtgcttccttcactgtgtcagttttccaaggcatcagcacctcggtggccatcctctgtgaggagttcccacatgagctaggagactttgtcatcctgctcaacgctgggatgagcatccaacaagctctcttcttcaacttcctttctgcctgctgctgctacctgggtctggcctttggcatcctggccggcagccacttctctgccaactggatttttgcgctagctggaggaatgttcttgtatatttctctggctgatatgttccctgagatgaatgaggtctgtcaagaggatgaaaggaagggcagcatcttgattccatttatcatccagaacctgggcctcctgactggattcaccatcatggtggtcctcaccatgtattcaggacagatccagattgggtagggctctgccaagagcctgtgggactggaagtcgggccctgggctgcccgatcgccagcccgaggacttaccatccacaatgcaccacggaagaggccgttctatgaaaaactgacacagactgtattcctgcattcaaatgtcagccgtttgtaaaatgctgtatcctaggaataagctgccctggtaaccagtctctagctagtgcctcttgccctctcctcacctccttttctctcagtgactctggaacctgaatgcagcttacaagacaagcctgacttttttctctgattaccttggcctcctcttggaaccagtgctgaaaggttttgaatcctttacccaacaatgcaaaaatagagccaatggttataacttggctagaaatatcaagagttgaatccatagtgtggggcccatgactctagctgggcaccttggacctccagctggccaatagaagagacaggagacaggaagccttcccattttttcaaagtctgtttaattgcctattacttctctcaaagagaacctgaagtcagaacacatgagcagggtgagaggtgaggcaaggttcatcctgaatgggagaggaagtcgaaccactgctgtgtgtcttgtcaggatgctcacttgttcctactgagatgctggatattgattttgtaacagcacctggtgtttcacggctgtccgagtgagctaacgtggcggtgtggctgcctggacctcctctttcaggttaacgctgacagaatggaggctcaggctgtctgcaagaaaacagttggtttggctgtgattttgacctcctcttccccactgccatcttctaagagactttgtagctgcctcctagaagcacattctgagcacatttgagacctctgtgttagaggggagactgcacaaactatcctcccccaggttgagacgtctgcagagtggcaagctgacttgtagaaatggggtgccatttatgctctacttagacaagggtaatcagaaatggaatcagtgcaggcaaaatttaggatttgccgcttccataaatcaaagcatgactaatagggggtctctgaaatgtaagggcacaaacttcacttagggcatcgcagatgtttgcagaatggttggcctaatgattatgctacagatgggttttaaatgacccgtctaggttactgcttccttgcaaaaaaagtcgaatcctgcattgaattgaatatgaatttctctaactctctccagaaaatggatggagataacttgtctttaaaactgtaggccagccttagccactgtggagcccttgcctccgagctctggcttcaaggggagctcttctccaggttcactaggtgaattgatttattattatcatattgataatgtgagattctttagccactttggggagcctgtctctccagaagcctttcttagtggtgcccacagttggagcccaggggccatgtttgcaaactgattcatgtgcatggctgacaggagtactggttcactaccaatgcctgagcttttctcttacatagaaaaactgtccgctctcagtaatcacaagcagcatccgttttgttttctcttcttgggagacatctgtcaaaccaggaatattcttgaaaagaacgtgagcaggaaaaactgctggtgatactttttttaagttttgtttttatcttgcctgttggcttcaatacatttgagaatacgctgaagagggaaaatttcagtgatggagattctagattaaatatcaggactgatttcctggtgggattatggtccagttttaccaaagaaccaattccttgaatgttggaatctaactttttatattgtcattattattgttgtttttaaacggttctttgtcttttctgttttatttttctcaagctgctttcaggagctagcagaaaataactcaaagttgaagactctggaagattttgctttaacctaactcgcattgatgtattaaatttataattttagcattcccaatagatcctatcattccttaaacataataccctttgtcttggagtagaatactaagttagagttagtggatttctagtttaggagaggagctcaaaactataatctttaacaaattgaaaaatgaaatagggtgttttccctttttgtgcacacctatattaccttaagaaatttccttccatagacagctgcctcaaagggaaatcctctttaaaccgtagttggcgcagaggtcagtcctagtcggagcttaggaggggcggagacgctcacatcgtctgacttgagtcgccactgattgtggcaacagctttgcctcatgagtcaaaaattggcaatttcttttgatttttagttgttgaatttgctgtttcaagcatttgtacatattagaagtctaaggagtagcaagtcagtgggaggactttttcacccctggcattagcagcttcgacctcattttccagatgcaccagctcctattaataagttagcaaggaaagtgtatgtcacgtgcaggaacagtgaggcagggacaggggttctgctccttctcacttcaccaccggcacacagcttgcccctgtctttgcccccaaaggtattttgtgtctagtgtcaaattggagctattcttcactggtccttaaccttgggttttaaaaagaaggcttctctgtttgggtagcgtaagagctgagtatagtaagtcctcttccaaagagatggcaatatgctgggcatctactttaaaacaaagttgtctgatttttgcaagagaggttaggattttattgttcttatttccctttacagttctgcagttccatcacagtatttttttaaataactcaggtgtatgagaagaaattagaaaagaaaattaacttatgtggactgtaaatgttttatttgtaagattctataaataaagctatattctgt

SEQ ID NO: 1190 - DNA, 4007 bp, Homo sapiens
caggtttattcagtcaccatgaagctgctgctgctgcacccggccttccagagctgcctcctgctgaccctgcttggcttatggagaaccacccctgaggctcacgcttcatccctgggtgcaccagctatcagcgctgcctccttcctgcaggatctaatacatcggtatggcgagggtgacagcctcactctgcagcagctgaaggccctactcaaccacctggatgtgggagtgggccggggtaatgtcacccagcacgtgcaaggacacaggaacctctccacgtgctttagttctggagacctcttcactgcccacaatttcagcgagcagtcgcggattgggagcagcgagctccaggagttctgccccaccatcctccagcagctggattcccgggcctgcacctcggagaaccaggaaaacgaggagaatgagcagacggaggaggggcggccaagcgctgttgaagtgtggggatacggtctcctctgtgtgaccgtcatctccctctgctccctcctgggggccagcgtggtgcccttcatgaagaagaccttttacaagaggctgctgctctacttcatagctctggcgattggaaccctctactccaacgccctcttccagctcatcccggaggcatttggtttcaaccctctggaagattattatgtctccaagtctgcagtggtgtttgggggcttttatcttttctttttcacagagaagatcttgaagattcttcttaagcagaaaaatgagcatcatcatggacacagccattatgcctctgagtcgcttccctccaagaaggaccaggaggagggggtgatggagaagctgcagaacggggacctggaccacatgattcctcagcactgcagcagtgagctggacggcaaggcgcccatggtggacgagaaggtcattgtgggctcgctctctgtgcaggacctgcaggcttcccagagtgcttgctactggctgaaaggtgtccgctactctgatatcggcactctggcctggatgatcactctgagcgacggcctccataatttcatcgatggcctggccatcggtgcttccttcactgtgtcagttttccaaggcatcagcacctcggtggccatcctctgtgaggagttcccacatgagctaggagactttgtcatcctgctcaacgctgggatgagcatccaacaagctctcttcttcaacttcctttctgcctgctgctgctacctgggtctggcctttggcatcctggccggcagccacttctctgccaactggatttttgcgctagctggaggaatgttcttgtatatttctctggctgatatgttccctgagatgaatgaggtctgtcaagaggatgaaaggaagggcagcatcttgattccatttatcatccagaacctgggcctcctgactggattcaccatcatggtggtcctcaccatgtattcaggacagatccagattgggtagggctctgccaagagcctgtgggactggaagtcgggccctgggctgcccgatcgccagcccgaggacttaccatccacaatgcaccacggaagaggccgttctatgaaaaactgacacagactgtattcctgcattcaaatgtcagccgtttgtaaaatgctgtatcctaggaataagctgccctggtaaccagtctctagctagtgcctcttgccctctcctcacctccttttctctcagtgactctggaacctgaatgcagcttacaagacaagcctgacttttttctctgattaccttggcctcctcttggaaccagtgctgaaaggttttgaatcctttacccaacaatgcaaaatgtggggcccatgactctagctgggcaccttggacctccagctggccaatagaagagacaggagacaggaagccttcccattttttcaaagtctgtttaattgcctattacttctctcaaagagaacctgaagtcagaacacatgagcagggtgagaggtgaggcaaggttcatcctgaatgggagaggaagtcgaaccactgctgtgtgtcttgtcaggatgctcacttgttcctactgagatgctggatattgattttgtaacagcacctggtgtttcacggctgtccgagtgagctaacgtggcggtgtggctgcctggacctcctctttcaggttaacgctgacagaatggaggctcaggctgtctgcaagaaaacagttggtttggctgtgattttgacctcctcttccccactgccatcttctaagagactttgtagctgcctcctagaagcacattctgagcacatttgagacctctgtgttagaggggagactgcacaaactatcctcccccaggttgagacgtctgcagagtggcaagctgacttgtagaaatggggtgccatttatgctctacttagacaagggtaatcagaaatggaatcagtgcaggcaaaatttaggatttgccgcttccataaatcaaagcatgactaatagggggtctctgaaatgtaagggcacaaacttcacttagggcatcgcagatgtttgcagaatggttggcctaatgattatgctacagatgggttttaaatgacccgtctaggttactgcttccttgcaaaaaaagtcgaatcctgcattgaattgaatatgaatttctctaactctctccagaaaatggatggagataacttgtctttaaaactgtaggccagccttagccactgtggagcccttgcctccgagctctggcttcaaggggagctcttctccaggttcactaggtgaattgatttattattatcatattgataatgtgagattctttagccactttggggagcctgtctctccagaagcctttcttagtggtgcccacagttggagcccaggggccatgtttgcaaactgattcatgtgcatggctgacaggagtactggttcactaccaatgcctgagcttttctcttacatagaaaaactgtccactctcagtaatcacaagcagcatccgttttgttttctcttcttgggagacatctgtcaaaccaggaatattcttgaaaagaacgtgagcaggaaaaactgctggtgatactttttttaagttttgtttttatcttgcctgttggcttcaatacatttgagaatacgctgaagagggaaaatttcagtgatggagattctagattaaatatcaggactgatttcctggtgggaggattatggtccagttttaccaaagaaccaattccttgaatgttggaatctaactttttatattgtcattattattgttgtttttaaacggttctttgtcttttctgttttatttttctcaagctgctttcaggagctagcagaaaataactcaaagttgaagactctggaagattttgctttaacctaactcgcattgatgtattaaatttataattttagcattcccaatagatcctatcattccttaaacataataccctttgtcttggagtagaatactaagttagagttagtggatttctagtttaggagaggagctcaaaactataatctttaacaaattgaaaaatgaaatagggtgttttccctttttgtgcacacctatattaccttaagaaatttccttccatagacagctgcctcaaagggaaatcctctttaaaccgtagttggcgcagaggtcagtcctagtcggagcttaggaggggcggagacgctcacatcgtctgacttgagtcgccactgattgtggcaacagctttgcctcatgacatttgtacatattagaagtctaaggagtagcaagtcagtgggaggactttttcacccctggcattagcagcttcgacctcattttccagatgcaccagctcctattaataagttagcaaggaaagtgtatgtcacgtgcaggaacagtgaggcagggacaggggttctgctccttctcacttcaccaccggcacacagcttgccc

SEQ ID NO: 1191 - DNA, 4152 bp, Homo sapiens
ggccgcgggaagacccgagagtcattagaagcgcaagatggcgactgcggccgaaacctcggcttcagaacccgaggctgagtccaaggctgggcccaaggctgacggagaggaggatgaggttaaggcggctaggacaaggagaaaggtgttatcgcgggctgtggccgctgcgacatacaagaccatggggccagcgtgggatcagcaggaggaaggcgtgagcgagagcgatggggatgagtacgccatggcttcctccgcggagagctcccccggggagtacgagtgggaatatgacgaagaggaggagaaaaaccagctggagattgagagactggaggagcagttgtctatcaacgtctatgactacaactgccatgtggacttgatcagactgctcaggctggaaggggagcttaccaaggtgaggatggcccgccagaagatgagtgaaatctttcccttgactgaagagctctggctggagtggctgcatgacgagatcagcatggcccaggatggcctggacagagagcacgtgtatgacctctttgagaaagccgtgaaggattacatttgtcctaacatttggctagagtatggccagtactcagttggtgggattggtcagaaaggtggccttgagaaagttcgctccgtgtttgaaagggctctctcgtctgttggtttacatatgaccaaaggactcgccctctgggaggcttaccgagagtttgaaagtgcgattgtggaagctgctcggcttgagaaagtccacagtcttttccggcgacagttggcgatcccactctatgatatggaggccacatttgcagagtatgaagaatggtcagaagacccaataccagagtcagtaattcagaactataacaaagcactacagcagctggagaaatataaaccctatgaagaagcactgttgcaggcagaggcaccaaggctggcagaatatcaagcatatatcgattttgagatgaaaattggcgatcctgctcgcattcagttgatctttgagcgcgccctggtcgagaactgccttgtcccagacttatggatccgttacagtcagtacctagatcgacaactgaaagtaaaggatttggttttatctgtacataaccgcgctattagaaactgcccctggacagttgccttatggagtcggtacctcttggccatggagagacatggagttgatcatcaagtaatttctgtaaccttcgagaaagctttgaatgccggcttcatccaggccactgattatgtggagatttggcaggcataccttgattacctgaggagaagggttgatttcaaacaagactccagtaaagagctggaggagttgagggccgcctttactcgtgccttggagtatctgaagcaggaggtggaagagcgtttcaatgagagtggtgatccaagctgcgtgattatgcagaactgggctaggattgaggctcgactgtgcaataacatgcagaaagctcgggaactctgggatagcatcatgaccagaggaaatgccaagtacgccaacatgtggctagagtattacaacctggaaagagctcatggtgacacccagcactgccggaaggctctgcaccgggccgtccagtgcaccagtgactacccagagcacgtctgcgaagtgttactcaccatggagaggacagaaggttctttagaagattgggatatagctgttcagaaaactgaaacccgattagctcgtgtcaatgagcagagaatgaaggctgcagagaaggaagcagcccttgtgcagcaagaagaagaaaaggctgaacaacggaaaagagctcgggctgagaagaaagcgttaaaaaagaagaaaaagatcagaggcccagagaagcgcggagcagatgaggatgatgagaaagagtggggcgatgatgaagaagagcagccttccaaacgcagaagggtcgagaacagcatccctgcagctggagaaacacaaaatgtagaagtagcagcagggcccgctgggaaatgtgctgccgtagatgtggagcccccttcgaagcagaaggagaaggcagcctccctgaagagggacatgcccaaggtgctgcacgacagcagcaaggacagcatcaccgtctttgtcagcaacctgccctacagcatgcaggagccggacacgaagctcaggccactcttcgaggcctgtggggaggtggtccagatccgacccatcttcagcaaccgtggggatttccgaggttactgctacgtggagtttaaagaagagaaatcagcccttcaggcactggagatggaccggaaaagtgtagaagggaggccaatgtttgtttccccctgtgtggataagagcaaaaaccccgattttaaggtgttcaggtacagcacttccctagagaaacacaagctgttcatctcaggcctgcctttctcctgtactaaagaggaactagaagaaatctgtaaggctcatggcaccgtgaaggacctcaggctggtcaccaaccgggctggcaaaccaaagggcctggcctacgtggagtatgaaaatgaatcccaggcgtcgcaggctgtgatgaagatggacggcatgactatcaaagagaacatcatcaaagtggcaatcagcaaccctcctcagaggaaagttccagagaagccggagaccaggaaggcaccaggtggccccatgcttttgccgcagacatacggagcgagggggaagggaaggacgcagctgtctctactgcctcgtgccctgcagcgcccaagtgctgcagctcctcaggctgagaacggccctgccgcggctcctgcagttgccgccccagcagccaccgaggcacccaagatgtccaatgccgattttgccaagctgtttctgagaaagtgaacgggacgctgggagacaggaaatgccttacttcactctggcccggcggacctcccaccacccagcagtgcactggggatggacaggcctggtgtgctgcgtgctcgcaaccacagatggctcctcggctttagacagaaaggggaaggggttctaagtcaagagcctttcagtgctccctcatattgagggcagtggcagaaaagtgaccactctgcaggctgggcccaggatgtggtgtcctgagatagttttgtatcttaaagactgaggcacagaagcgaaacgagaacacactgtttttgagacacagttgtccaaatgtttctggccagctccggcccctttttgtatgacacttctcttccaccctgcacagcacatgtgcccgtcattcttttaattttaaaagatgaaatggcagatgctagtaattcacagaatggcctcttgtgggggtgggtctgagggaagtcagctataaaacatttgctggagttttgttcaatggggctgtgcatttttatattatgtgtttgtaaatgacatgtcagcccttgtttcatgtttcctaaaagcagaatatttgcaacatttgttttgtataggaattatttgtgccacctgctgtggactgttttctttgcctagtgactagtgacctgtgttgtctaaacatgagtttcagccctttggttttgtttaataccatgtcaaatgcaaacttcaattctccccatttagctttattaaactgacgttctcttcaaaacttcttgctgaatggtactcagatgtgcattcacatacagatgtgttttgaagtgggtgtaccttgctttacctaatagatgtgtaaatagaacttttgtaagtcaaatcccattgtcactttgatttaaattattccagctgtgatgtgtcttcattttatagcagtttgacactggagcttttgagcttttttacctcacatcttttatcaaataatatttactgctttgaaaacagcaacagcattggccagttcagtaggggaagcttgctttattaagacactctggagaaagacgtcagggaatccttgtatatgtcgtgggaatcaactcctcatttatctgttgcgtaagtttaagtttttgtgcatcagtcgggttttctatatttttttaacttaacattttttaatataaccgattaaaaagtagacagaacagtaaaat

SEQ ID NO: 1192 - DNA, 8850 bp, Homo sapiens; identical to SEQ ID NO: 739

SEQ ID NO: 1193 - DNA, 315 bp, Homo sapiens
atggcaaaaatctccggccctacagagactgcgcggtgcattgagtccctgatagctgttttccagaagtatgctggaaaggatggttacaactgcaatctctccaagacggagttcccaagcttcatgaataaagagctggctgcctttacaaagaaccagaaggaccccggtgtccttgaccgcatgaagaaactggctgtcagcagcgatgggtagttagatttcccaaaatttcttaatctgattggtggcctagctgcggcttgccatgactccttcctcaaggctgtcccttcccagaagtggaactga

SEQ ID NO: 1194 - DNA, 488 bp, Homo sapiens
ctcgctcagctccaacatggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaagaaccagaaggaccctggtgtccttgaccgcatgatgaagaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcacactaaccacctcatgcaggccccacctgccaatagtaataaagcaatgtcacttttttaaaacatg

SEQ ID NO: 1195 - DNA, 601 bp, Homo sapiens
gggcaaggctgggccgggaagggcgtgggttgaggagaggctccagacccgcacgccgcgcgcacagagctctcagcgccgctcccagccacagcctcccgcgcctcgctcagctccaacatggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaagaaccagaaggaccctggtgtccttgaccgcatgatgaagaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcacactaaccacctcatgcaggccccacctgccaatagtaataaagcaatgtcacttttttaaaacatgaactagaga

SEQ ID NO: 1196 - DNA, 378 bp, Homo sapiens
atggcaaaaatctccagccctacagagactgagcggtgcattgagtccctgattgctgttttccagaagtatgctggaaaggatggttacaaccgcaatctctccaagacggagttcctaagcttcatgaatacagagctggctgcctttacaaagaaccagaaggaccccggtgtccttgaccgcatgaagaaactggctgtcagcagcgatgggcagttagatttcccaaaatttcttaatctgattggtggcctagctgtggcttgccatgactccttcctcaaggctgtcccctcccagaagtagacctgaggaccccttgggcctggccttcaaacccaccccctttccttccagcctttctgtcatcatctc

SEQ ID NO: 1197 - DNA, 6433 bp, Homo sapiens
tgccggtggcctctgtggccgtccaggctagcggcggcccgcaggcggcggggagaaagactctctcacctggtcttgcggctgtggccaccgccggccaggggtgtggagggcgtgctgccggagacgtccgccgggctctgcagttccgccgggggtcgggcagctatggagccgcggcccacggcgccctcctccggcgccccgggactggccggggtcggggagacgccgtcagccgctgcgctggccgcagccagggtggaactgcccggcacggctgtgccctcggtgccggaggatgctgcgcccgcgagccgggacggcggcggggtccgcgatgagggccccgcggcggccggggacgggctgggcagacccttggggcccaccccgagccagagccgtttccaggtggacctggtttccgagaacgccgggcgggccgctgctgcggcggcggcggcggcggcggcagcggcggcggctggtgctggggcgggggccaagcagacccccgcggacggggaagccagcggcgagagcgagccggctaaaggcagcgaggaagccaagggccgcttccgcgtgaacttcgtggacccagctgcctcctcgtcggctgaagacagcctgtcagatgctgccggggtcggagtcgacgggcccaacgtgagcttccagaacggcggggacacggtgctgagcgagggcagcagcctgcactccggcggcggcggcggcagtgggcaccaccagcactactattatgatacccacaccaacacctactacctgcgcaccttcggccacaacaccatggacgctgtgcccaggatcgatcactaccggcacacagccgcgcagctgggcgagaagctgctccggcctagcctggcggagctccacgacgagctggaaaaggaaccttttgaggatggctttgcaaatggggaagaaagtactccaaccagagatgctgtggtcacgtatactgcagaaagtaaaggagtcgtgaagtttggctggatcaagggtgtattagtacgttgtatgttaaacatttggggtgtgatgcttttcattagattgtcatggattgtgggtcaagctggaataggtctatcagtccttgtaataatgatggccactgttgtgacaactatcacaggattgtctacttcagcaatagcaactaatggatttgtaagaggaggaggagcatattatttaatatctagaagtctagggccagaatttggtggtgcaattggtctaatcttcgcctttgccaacgctgttgcagttgctatgtatgtggttggatttgcagaaaccgtggtggagttgcttaaggaacattccatacttatgatagatgaaatcaatgatatccgaattattggagccattacagtcgtgattcttttaggtatctcagtagctggaatggagtgggaagcaaaagctcagattgttcttttggtgatcctacttcttgctattggtgatttcgtcataggaacatttatcccactggagagcaagaagccaaaagggttttttggttataaatctgaaatatttaatgagaactttgggcccgattttcgagaggaagagactttcttttctgtatttgccatcttttttcctgctgcaactggtattctggctggagcaaatatctcaggtgatcttgcagatcctcagtcagccatacccaaaggaacactcctagccattttaattactacattggtttacgtaggaattgcagtatctgtaggttcttgtgttgttcgagatgccactggaaacgttaatgacactatcgtaacagagctaacaaactgtacttctgcagcctgcaaattaaactttgatttttcatcttgtgaaagcagtccttgttcctatggcctaatgaacaacttccaggtaatgagtatggtgtcaggatttacaccactaatttctgcaggtatattttcagccactctttcttcagcattagcatccctagtgagtgctcccaaaatatttcaggctctatgtaaggacaacatctacccagctttccagatgtttgctaaaggttatgggaaaaataatgaacctcttcgtggctacatcttaacattcttaattgcacttggattcatcttaattgctgaactgaatgttattgcaccaattatctcaaacttcttccttgcatcatatgcattgatcaatttttcagtattccatgcatcacttgcaaaatctccaggatggcgtcctgcattcaaatactacaacatgtggatatcacttcttggagcaattctttgttgcatagtaatgttcgtcattaactggtgggctgcattgctaacatatgtgatagtccttgggctgtatatttatgttacctacaaaaaaccagatgtgaattggggatcctctacacaagccctgacttacctgaatgcactgcagcattcaattcgtctttctggagtggaagaccacgtgaaaaactttaggccacagtgtcttgttatgacaggtgctccaaactcacgtccagctttacttcatcttgttcatgatttcacaaaaaatgttggtttgatgatctgtggccatgtacatatgggtcctcgaagacaagccatgaaagagatgtccatcgatcaagccaaatatcagcgatggcttattaagaacaaaatgaaggcattttatgctccagtacatgcagatgacttgagagaaggtgcacagtatttgatgcaggctgctggtcttggtcgtatgaagccaaacacacttgtccttggatttaagaaagattggttgcaagcagatatgagggatgtggatatgtatataaacttatttcatgatgcttttgacatacaatatggagtagtggttattcgcctaaaagaaggtctggatatatctcatcttcaaggacaagaagaattattgtcatcacaagagaaatctcctggcaccaaggatgtggtagtaagtgtggaatatagtaaaaagtccgatttagatacttccaaaccactcagtgaaaaaccaattacacacaaagttgaggaagaggatggcaagactgcaactcaaccactgttgaaaaaagaatccaaaggccctattgtgcctttaaatgtagctgaccaaaagcttcttgaagctagtacacagtttcagaaaaaacaaggaaagaatactattgatgtctggtggctttttgatgatggaggtttgaccttattgataccttaccttctgacgaccaagaaaaaatggaaagactgtaagatcagagtattcattggtggaaagataaacagaatagaccatgaccggagagcgatggctactttgcttagcaagttccggatagacttttctgatatcatggttctaggagatatcaataccaaaccaaagaaagaaaatattatagcttttgaggaaatcattgagccatacagacttcatgaagatgataaagagcaagatattgcagataaaatgaaagaagatgaaccatggcgaataacagataatgagcttgaactttataagaccaagacataccggcagatcaggttaaatgagttattaaaggaacattcaagcacagctaatattattgtcatgagtctcccagttgcacgaaaaggtgctgtgtctagtgctctctacatggcatggttagaagctctatctaaggacctaccaccaatcctcctagttcgtgggaatcatcagagtgtccttaccttctattcataaatgttctatacagtggacagccctccagaatggtacttcagtgcctagtgtagtaactgaaatcttcaatgacacattaacatcacaatggcgaatggtgacttttctttcacgatttcattaatttgaaagcacacaggaaagttgctccattgataacgtgtatggagacttcggttttagtcaattccatatctcaatcttaatggtgattcttctctgttgaactgaagtttgtgagagtagttttcctttgctacttgaatagcaataaaagcgtgttaactttttgattgatgaaagaagtacaaaaagcctttagccttgaggtgccttctgaaattaaccaaatttcatccatatatcctcttttataaacttatagaatgtcaaactttgccttcaactgtttttatttctagtctcttccactttaaaacaaaatgaacactgcttgtcttcttccattgaccatttagtgttgagtactgtatgtgttttgttaattctataaaggtatctgttagatattaaaggtgagaattagggcaggttaatcaaaaatggggaaggggaaatggtaaccaaaaagtaaccccatggtaaggtttatatgagtatatgtgaatatagagctaggaaaaaaagcccccccaaatacctttttaacccctctgattggctattattactatatttattattatttattgaaaccttagggaagattgaagattcatcccatacttctatataccatgcttaaaaatcacgtcattctttaaacaaaaatactcaagatcatttatatttatttggagagaaaactgtcctaatttagaatttccctcaaatctgagggacttttaagaaatgctaacagatttttctggaggaaatttagacaaaacaatgtcatttagtagaatatttcagtatttaagtggaatttcagtatactgtactatcctttataagtcattaaaataatgtttcatcaaatggttaaatggaccactggtttcttagagaaatgtttttaggcttaattcattcaattgtcaagtacacttagtcttaatacactcaggtttgaacagattattctgaatattaaaatttaatccattcttaatattttaaaacttttgttaagaaaaactgccagtttgtgcttttgaaatgtctgttttgacatcatagtctagtaaaattttgacagtgcatatgtactgttactaaaagctttatatgaaattattaatgtgaagtttttcatttataattcaaggaaggatttcctgaaaacatttcaagggatttatgtctacatatttgtgtgtgtgtgtgtatatatatgtaatatgcatacacagatgcatatgtgtatatataatgaaatttatgttgctggtattttgcattttaaagtgatcaagattcattaggcaaactttggtttaagtaaacatatgttcaaatcagattaacagatacaggtttcatagagaacaaaggtgatcatttgaagggcatgctgtaatttcacacaattttccagttcaaaaatggagaatacttcgcctaaaatactgttaagtgggttaattgatacaagtttctgtggtggaaaatttatgcaggttttcacgaatcctttttttttttttttttttttttgagacggagtctcgctctgttgccacgctggaatgcagtaacgtgatcttggctcactgcgacctccacctccccagttcaagcgattctcctgcctcagcctccctagtagctgggactacgggtgcacgccaccatgcccagctaatttttgtattttgagtagagacagggtttcaccgtgttggctaggatggtgtctatctcttgaccttgtgatccacccgcctcagcctcccagagtgctgggattacaggtgcgagccactgcgcctggctggttttcatgaatcttgatagacatctataacgttattattttcagtggtgtgcagcatttttgcttcatgagtatgacctaggtatagagatctgataacttgaattcagaatattaagaaaatgaagtaactgattttctaaaaaaaaaaaaaaaaaaaatttctacattataactcacagcattgttccattgcaggttttgcaatgtttgggggtaaagacagtagaaatattattcagtaaacaataatgtgtgaacttttaagatggataatagggcatggactgagtgctgctatcttgaaatgtgcacaggtacacttaccttttttttttttttttttaagtttttcccattcaggaaaacaacattgtgatctgtactacaggaaccaaatgtcatgcgtcatacatgtgggtataaagtacataaaatatatctaactattcataatgtggggtgggtaatactgtctgtgaaataatgtaagaagcttttcacttaaaaaaaatgcattactttcacttaacactagacaccaggtcgaaaattttcaaggttatagtacttatttcaacaattcttagagatgctagctagtgttgaattctaatcattgatgatagcttggaaataaataattatgccatggcatttgacagt

SEQ ID NO: 1198 - DNA, 6850 bp, Homo sapiens
tgccggtggcctctgtggccgtccaggctagcggcggcccgcaggcggcggggagaaagactctctcacctggtcttgcggctgtggccaccgccggccaggggtgtggagggcgtgctgccggagacgtccgccgggctctgcagttccgccgggggtcgggcagctatggagccgcggcccacggcgccctcctccggcgccccgggactggccggggtcggggagacgccgtcagccgctgcgctggccgcagccagggtggaactgcccggcacggctgtgccctcggtgccggaggatgctgcgcccgcgagccgggacggcggcggggtccgcgatgagggccccgcggcggccggggacgggctgggcagacccttggggcccaccccgagccagagccgtttccaggtggacctggtttccgagaacgccgggcgggccgctgctgcggcggcggcggcggcggcggcagcggcggcggctggtgctggggcgggggccaagcagacccccgcggacggggaagccagcggcgagagcgagccggctaaaggcagcgaggaagccaagggccgcttccgcgtgaacttcgtggacccagctgcctcctcgtcggctgaagacagcctgtcagatgctgccggggtcggagtcgacgggcccaacgtgagcttccagaacggcggggacacggtgctgagcgagggcagcagcctgcactccggcggcggcggcggcagtgggcaccaccagcactactattatgatacccacaccaacacctactacctgcgcaccttcggccacaacaccatggacgctgtgcccaggatcgatcactaccggcacacagccgcgcagctgggcgagaagctgctccggcctagcctggcggagctccacgacgagctggaaaaggaaccttttgaggatggctttgcaaatggggaagaaagtactccaaccagagatgctgtggtcacgtatactgcagaaagtaaaggagtcgtgaagtttggctggatcaagggtgtattagtacgttgtatgttaaacatttggggtgtgatgcttttcattagattgtcatggattgtgggtcaagctggaataggtctatcagtccttgtaataatgatggccactgttgtgacaactatcacaggattgtctacttcagcaatagcaactaatggatttgtaagaggaggaggagcatattatttaatatctagaagtctagggccagaatttggtggtgcaattggtctaatcttcgcctttgccaacgctgttgcagttgctatgtatgtggttggatttgcagaaaccgtggtggagttgcttaaggaacattccatacttatgatagatgaaatcaatgatatccgaattattggagccattacagtcgtgattcttttaggtatctcagtagctggaatggagtgggaagcaaaagctcagattgttcttttggtgatcctacttcttgctattggtgatttcgtcataggaacatttatcccactggagagcaagaagccaaaagggttttttggttataaatctgaaatatttaatgagaactttgggcccgattttcgagaggaagagactttcttttctgtatttgccatcttttttcctgctgcaactggtattctggctggagcaaatatctcaggtgatcttgcagatcctcagtcagccatacccaaaggaacactcctagccattttaattactacattggtttacgtaggaattgcagtatctgtaggttcttgtgttgttcgagatgccactggaaacgttaatgacactatcgtaacagagctaacaaactgtacttctgcagcctgcaaattaaactttgatttttcatcttgtgaaagcagtccttgttcctatggcctaatgaacaacttccaggtaatgagtatggtgtcaggatttacaccactaatttctgcaggtatattttcagccactctttcttcagcattagcatccctagtgagtgctcccaaaatatttcaggctctatgtaaggacaacatctacccagctttccagatgtttgctaaaggttatgggaaaaataatgaacctcttcgtggctacatcttaacattcttaattgcacttggattcatcttaattgctgaactgaatgttattgcaccaattatctcaaacttcttccttgcatcatatgcattgatcaatttttcagtattccatgcatcacttgcaaaatctccaggatggcgtcctgcattcaaatactacaacatgtggatatcacttcttggagcaattctttgttgcatagtaatgttcgtcattaactggtgggctgcattgctaacatatgtgatagtccttgggctgtatatttatgttacctacaaaaaaccagatgtgaattggggatcctctacacaagccctgacttacctgaatgcactgcagcattcaattcgtctttctggagtggaagaccacgtgaaaaactttaggccacagtgtcttgttatgacaggtgctccaaactcacgtccagctttacttcatcttgttcatgatttcacaaaaaatgttggtttgatgatctgtggccatgtacatatgggtcctcgaagacaagccatgaaagagatgtccatcgatcaagccaaatatcagcgatggcttattaagaacaaaatgaaggcattttatgctccagtacatgcagatgacttgagagaaggtgcacagtatttgatgcaggctgctggtcttggtcgtatgaagccaaacacacttgtccttggatttaagaaagattggttgcaagcagatatgagggatgtggatatgtatataaacttatttcatgatgcttttgacatacaatatggagtagtggttattcgcctaaaagaaggtctggatatatctcatcttcaaggacaagaagaattattgtcatcacaagagaaatctcctggcaccaaggatgtggtagtaagtgtggaatatagtaaaaagtccgatttagatacttccaaaccactcagtgaaaaaccaattacacacaaagttgaggaagaggatggcaagactgcaactcaaccactgttgaaaaaagaatccaaaggccctattgtgcctttaaatgtagctgaccaaaagcttcttgaagctagtacacagtttcagaaaaaacaaggaaagaatactattgatgtctggtggctttttgatgatggaggtttgaccttattgataccttaccttctgacgaccaagaaaaaatggaaagactgtaagatcagagtattcattggtggaaagataaacagaatagaccatgaccggagagcgatggctactttgcttagcaagttccggatagacttttctgatatcatggttctaggagatatcaataccaaaccaaagaaagaaaatattatagcttttgaggaaatcattgagccatacagacttcatgaagatgataaagagcaagatattgcagataaaatgaaagaagatgaaccatggcgaataacagataatgagcttgaactttataagaccaagacataccggcagatcaggttaaatgagttattaaaggaacattcaagcacagctaatattattgtcatgagtctcccagttgcacgaaaaggtgctgtgtctagtgctctctacatggcatggttagaagctctatctaaggacctaccaccaatcctcctagttcgtgggaatcatcagagtgtccttaccttctattcataaatgttctatacagtggacagccctccagaatggtacttcagtgcctagtgtagtaactgaaatcttcaatgacacattaacatcacaatggcgaatggtgacttttctttcacgatttcattaatttgaaagcacacaggaaagttgctccattgataacgtgtatggagacttcggttttagtcaattccatatctcaatcttaatggtgattcttctctgttgaactgaagtttgtgagagtagttttcctttgctacttgaatagcaataaaagcgtgttaactttttgattgatgaaagaagtacaaaaagcctttagccttgaggtgccttctgaaattaaccaaatttcatccatatatcctcttttataaacttatagaatgtcaaactttgccttcaactgtttttatttctagtctcttccactttaaaacaaaatgaacactgcttgtcttcttccattgaccatttagtgttgagtactgtatgtgttttgttaattctataaaggtatctgttagatattaaaggtgagaattagggcaggttaatcaaaaatggggaaggggaaatggtaaccaaaaagtaaccccatggtaaggtttatatgagtatatgtgaatatagagctaggaaaaaaagcccccccaaatacctttttaacccctctgattggctattattactatatttattattatttattgaaaccttagggaagattgaagattcatcccatacttctatataccatgcttaaaaatcacgtcattctttaaacaaaaatactcaagatcatttatatttatttggagagaaaactgtcctaatttagaatttccctcaaatctgagggacttttaagaaatgctaacagatttttctggaggaaatttagacaaaacaatgtcatttagtagaatatttcagtatttaagtggaatttcagtatactgtactatcctttataagtcattaaaataatgtttcatcaaatggttaaatggaccactggtttcttagagaaatgtttttaggcttaattcattcaattgtcaagtacacttagtcttaatacactcaggtttgaacagattattctgaatattaaaatttaatccattcttaatattttaaaacttttgttaagaaaaactgccagtttgtgcttttgaaatgtctgttttgacatcatagtctagtaaaattttgacagtgcatatgtactgttactaaaagctttatatgaaattattaatgtgaagtttttcatttataattcaaggaaggatttcctgaaaacatttcaagggatttatgtctacatatttgtgtgtgtgtgtgtatatatatgtaatatgcatacacagatgcatatgtgtatatataatgaaatttatgttgctggtattttgcattttaaagtgatcaagattcattaggcaaactttggtttaagtaaacatatgttcaaatcagattaacagatacaggtttcatagagaacaaaggtgatcatttgaagggcatgctgtaatttcacacaattttccagttcaaaaatggagaatacttcgcctaaaatactgttaagtgggttaattgatacaagtttctgtggtggaaaatttatgcaggttttcacgaatcctttttttttttttttttttttttgagacggagtctcgctctgttgccacgctggaatgcagtaacgtgatcttggctcactgcgacctccacctccccagttcaagcgattctcctgcctcagcctccctagtagctgggactacgggtgcacgccaccatgcccagctaatttttgtattttgagtagagacagggtttcaccgtgttggctaggatggtgtctatctcttgaccttgtgatccacccgcctcagcctcccagagtgctgggattacaggtgcgagccactgcgcctggctggttttcatgaatcttgatagacatctataacgttattattttcagtggtgtgcagcatttttgcttcatgagtatgacctaggtatagagatctgataacttgaattcagaatattaagaaaatgaagtaactgattttctaaaaaaaaaaaaaaaaaaaatttctacattataactcacagcattgttccattgcaggttttgcaatgtttgggggtaaagacagtagaaatattattcagtaaacaataatgtgtgaacttttaagatggataatagggcatggactgagtgctgctatcttgaaatgtgcacaggtacacttaccttttttttttttttttttaagtttttcccattcaggaaaacaacattgtgatctgtactacaggaaccaaatgtcatgcgtcatacatgtgggtataaagtacataaaatatatctaactattcataatgtggggtgggtaatactgtctgtgaaataatgtaagaagcttttcacttaaaaaaaatgcattactttcacttaacactagacaccaggtcgaaaattttcaaggttatagtacttatttcaacaattcttagagatgctagctagtgttgaagctaaaaatagctttatttatgctgaattgtgatttttttatgccaaattttttttagttctaatcattgatgatagcttggaaataaataattatgccatggcatttgacagttcattattcctataagaattaaattgagtttagagagaatggtggtgttgagctgattattaacagttactgaaatcaaatatttatttgttacattattccatttgtattttaggtttccttttacattctttttatatgcattctgacattacatattttttaagactatggaaataatttaaagatttaagctctggtggatgattatctgctaagtaagtctgaaaatgtaatattttgataatactgtaatatacctgtcacacaaatgcttttctaatgttttaaccttgagtattgcagttgctgctttgtacagaggttactgcaataaaggaagtggattcattaaacct

SEQ ID NO: 1199 - DNA, 6891 bp, Homo sapiens
ggtggcctctgtggccgtccaggctagcggcggcccgcaggcggcggggagaaagactctctcacctggtcttgcggctgtggccaccgccggccaggggtgtggagggcgtgctgccggagacgtccgccgggctctgcagttccgccgggggtcgggcagctatggagccgcggcccacggcgccctcctccggcgccccgggactggccggggtcggggagacgccgtcagccgctgcgctggccgcagccagggtggaactgcccggcacggctgtgccctcggtgccggaggatgctgcgcccgcgagccgggacggcggcggggtccgcgatgagggccccgcggcggccggggacgggctgggcagacccttggggcccaccccgagccagagccgtttccaggtggacctggtttccgagaacgccgggcgggccgctgctgcggcggcggcggcggcggcggcagcggcggcggctggtgctggggcgggggccaagcagacccccgcggacggggaagccagcggcgagagcgagccggctaaaggcagcgaggaagccaagggccgcttccgcgtgaacttcgtggacccagctgcctcctcgtcggctgaagacagcctgtcagatgctgccggggtcggagtcgacgggcccaacgtgagcttccagaacggcggggacacggtgctgagcgagggcagcagcctgcactccggcggcggcggcggcagtgggcaccaccagcactactattatgatacccacaccaacacctactacctgcgcaccttcggccacaacaccatggacgctgtgcccaggatcgatcactaccggcacacagccgcgcagctgggcgagaagctgctccggcctagcctggcggagctccacgacgagctggaaaaggaaccttttgaggatggctttgcaaatggggaagaaagtactccaaccagagatgctgtggtcacgtatactgcagaaagtaaaggagtcgtgaagtttggctggatcaagggtgtattagtacgttgtatgttaaacatttggggtgtgatgcttttcattagattgtcatggattgtgggtcaagctggaataggtctatcagtccttgtaataatgatggccactgttgtgacaactatcacaggattgtctacttcagcaatagcaactaatggatttgtaagaggaggaggagcatattatttaatatctagaagtctagggccagaatttggtggtgcaattggtctaatcttcgcctttgccaacgctgttgcagttgctatgtatgtggttggatttgcagaaaccgtggtggagttgcttaaggaacattccatacttatgatagatgaaatcaatgatatccgaattattggagccattacagtcgtgattcttttaggtatctcagtagctggaatggagtgggaagcaaaagctcagattgttcttttggtgatcctacttcttgctattggtgatttcgtcataggaacatttatcccactggagagcaagaagccaaaagggttttttggttataaatctgaaatatttaatgagaactttgggcccgattttcgagaggaagagactttcttttctgtatttgccatcttttttcctgctgcaactggtattctggctggagcaaatatctcaggtgatcttgcagatcctcagtcagccatacccaaaggaacactcctagccattttaattactacattggtttacgtaggaattgcagtatctgtaggttcttgtgttgttcgagatgccactggaaacgttaatgacactatcgtaacagagctaacaaactgtacttctgcagcctgcaaattaaactttgatttttcatcttgtgaaagcagtccttgttcctatggcctaatgaacaacttccaggtaatgagtatggtgtcaggatttacaccactaatttctgcaggtatattttcagccactctttcttcagcattagcatccctagtgagtgctcccaaaatatttcaggctctatgtaaggacaacatctacccagctttccagatgtttgctaaaggttatgggaaaaataatgaacctcttcgtggctacatcttaacattcttaattgcacttggattcatcttaattgctgaactgaatgttattgcaccaattatctcaaacttcttccttgcatcatatgcattgatcaatttttcagtattccatgcatcacttgcaaaatctccaggatggcgtcctgcattcaaatactacaacatgtggatatcacttcttggagcaattctttgttgcatagtaatgttcgtcattaactggtgggctgcattgctaacatatgtgatagtccttgggctgtatatttatgttacctacaaaaaaccagatgtgaattggggatcctctacacaagccctgacttacctgaatgcactgcagcattcaattcgtctttctggagtggaagaccacgtgaaaaactttaggccacagtgtcttgttatgacaggtgctccaaactcacgtccagctttacttcatcttgttcatgatttcacaaaaaatgttggtttgatgatctgtggccatgtacatatgggtcctcgaagacaagccatgaaagagatgtccatcgatcaagccaaatatcagcgatggcttattaagaacaaaatgaaggcattttatgctccagtacatgcagatgacttgagagaaggtgcacagtatttgatgcaggctgctggtcttggtcgtatgaagccaaacacacttgtccttggatttaagaaagattggttgcaagcagatatgagggatgtggatatgtatataaacttatttcatgatgcttttgacatacaatatggagtagtggttattcgcctaaaagaaggtctggatatatctcatcttcaaggacaagaagaattattgtcatcacaagagaaatctcctggcaccaaggatgtggtagtaagtgtggaatatagtaaaaagtccgatttagatacttccaaaccactcagtgaaaaaccaattacacacaaagttgaggaagaggatggcaagactgcaactcaaccactgttgaaaaaagaatccaaaggccctattgtgcctttaaatgtagctgaccaaaagcttcttgaagctagtacacagtttcagaaaaaacaaggaaagaatactattgatgtctggtggctttttgatgatggaggtttgaccttattgataccttaccttctgacgaccaagaaaaaatggaaagactgtaagatcagagtattcattggtggaaagataaacagaatagaccatgaccggagagcgatggctactttgcttagcaagttccggatagacttttctgatatcatggttctaggagatatcaataccaaaccaaagaaagaaaatattatagcttttgaggaaatcattgagccatacagacttcatgaagatgataaagagcaagatattgcagataaaatgaaagaagatgaaccatggcgaataacagataatgagcttgaactttataagaccaagacataccggcagatcaggttaaatgagttattaaaggaacattcaagcacagctaatattattgtcatgagtctcccagttgcacgaaaaggtgctgtgtctagtgctctctacatggcatggttagaagctctatctaaggacctaccaccaatcctcctagttcgtgggaatcatcagagtgtccttaccttctattcataaatgttctatacagtggacagccctccagaatggtacttcagtgcctagtgtagtaactgaaatcttcaatgacacattaacatcacaatggcgaatggtgacttttctttcacgatttcattaatttgaaagcacacaggaaagttgctccattgataacgtgtatggagacttcggttttagtcaattccatatctcaatcttaatggtgattcttctctgttgaactgaagtttgtgagagtagttttcctttgctacttgaatagcaataaaagcgtgttaactttttgattgatgaaagaagtacaaaaagcctttagccttgaggtgccttctgaaattaaccaaatttcatccatatatcctcttttataaacttatagaatgtcaaactttgccttcaactgtttttatttctagtctcttccactttaaaacaaaatgaacactgcttgtcttcttccattgaccatttagtgttgagtactgtatgtgttttgttaattctataaaggtatctgttagatattaaaggtgagaattagggcaggttaatcaaaaatggggaaggggaaatggtaaccaaaaagtaaccccatggtaaggtttatatgagtatatgtgaatatagagctaggaaaaaaagcccccccaaatacctttttaacccctctgattggctattattactatatttattattatttattgaaaccttagggaagattgaagattcatcccatacttctatataccatgcttaaaaatcacgtcattctttaaacaaaaatactcaagatcatttatatttatttggagagaaaactgtcctaatttagaatttccctcaaatctgagggacttttaagaaatgctaacagatttttctggaggaaatttagacaaaacaatgtcatttagtagaatatttcagtatttaagtggaatttcagtatactgtactatcctttataagtcattaaaataatgtttcatcaaatggttaaatggaccactggtttcttagagaaatgtttttaggcttaattcattcaattgtcaagtacacttagtcttaatacactcaggtttgaacagattattctgaatattaaaatttaatccattcttaatattttaaaacttttgttaagaaaaactgccagtttgtgcttttgaaatgtctgttttgacatcatagtctagtaaaattttgacagtgcatatgtactgttactaaaagctttatatgaaattattaatgtgaagtttttcatttataattcaaggaaggatttcctgaaaacatttcaagggatttatgtctacatatttgtgtgtgtgtgtgtatatatatgtaatatgcatacacagatgcatatgtgtatatataatgaaatttatgttgctggtattttgcattttaaagtgatcaagattcattaggcaaactttggtttaagtaaacatatgttcaaaatcagattaacagatacaggtttcatagagaacaaaggtgatcatttgaagggcatgctgtaatttcacacaattttccagttcaaaaatggagaatacttcgcctaaaatactgttaagtgggttaattgatacaagtttctgtggtggaaaatttatgcaggttttcacgaatccttttttttttttttttttttttttgagacggagtcttgctctgttgccacgctggaatgcagtaacgtgatcttggctcactgcgacctccacctccccagttcaagcgattctcctgcctcagcctccctagtagctgggactacgggtgcacgccaccatgcccagctaatttttgtattttgagtagagacagggtttcaccgtgttggctaggatggtgtctatctcttgaccttgtgatccacccgcctcagcctcccagagtgctgggattacaggtgcgagccactgcgcctggctggttttcatgaatcttgatagacatctataacgttattattttcagtggtgtgcagcatttttgcttcatgagtatgacctaggtatagagatctgataacttgaattcagaatattaagaaaatgaagtaactgattttctaaaaaaaaaaaaaaaaaaaatttctacattataactcacagcattgttccattgcaggttttgcaatgtttgggggtaaagacagtagaaatattattcagtaaacaataatgtgtgaacttttaagatggataatagggcatggactgagtgctgctatcttgaaatgtgcacaggtacacttaccttttttttttttttttttaagtttttcccattcaggaaaacaacattgtgatctgtactacaggaaccaaatgtcatgcgtcatacatgtgggtataaagtacataaaatatatctaactattcataatgtggggtgggtaatactgtctgtgaaataatgtaagaagcttttcacttaaaaaaaatgcattactttcacttaacactagacaccaggtcgaaaattttcaaggttatagtacttatttcaacaattcttagagatgctagctagtgttgaagctaaaaatagctttatttatgctgaattgtgatttttttatgccaaattttttttagttctaatcattgatgatagcttggaaataaataattatgccatggcatttgacagttcattattcctataagaattaaattgagtttagagagaatggtggtgttgagctgattattaacagttactgaaatcaaatatttatttgttacattattccatttgtattttaggtttccttttacattctttttatatgcattctgacattacatattttttaagactatggaaataatttaaagatttaagctctggtggatgattatctgctaagtaagtctgaaaatgtaatattttgataatactgtaatatacctgtcacacaaatgcttttctaatgttttaaccttgagtattgcagttgctgctttgtacagaggttactgcaataaaggaagtggattcattaaacctatttaatgtccaaaaaaaaaaaaaaaaaaaaaaaaaaaaaaaa

SEQ ID NO: 1200 - DNA, 2443 bp, Homo sapiens
agcgcggcgcgggcccaacgagcgcacgcgtacacgcgtgcgcaggggaagaccgagtgccaggggctgaaccgcagggaagggggcgcggcgcacgcagtatggcgcccaacatctacttggttcgccagcggatcagtcgactcggccagaggatgtccggcttccagatcaacctcaacccgctcaaggagccactcggcttcatcaaggtcctcgagtggattgcttctatctttgcttttgccacctgtggaggttttaagggccaaacagaaattcaagtgaattgtcctcctgcagttactgagaataaaactgttacagctacttttggttatccattcaggttgaatgaggcatcatttcagccacctccaggtgtaaacatatgtgatgtaaattggaaagattacgtcctcataggcgattactcttcttctgcacaattctatgttacctttgcagtctttgtgttcctgtactgcattgctgcccttctgctttatgttggctacacgagtctgtatctggatagtcgtaaacttcctatgatagactttgttgttacacttgttgccacttttttgtggttggtgagcacttcagcctgggctaaagctctgacagatattaaaatagctactggtcacaatattattgatgaacttccgccttgtaagaagaaagcagtactgtgttactttggctctgtgaccagtatgggatccctaaatgtatctgtgatatttggctttctaaatatgatactctggggaggaaatgcttggtttgtgtacaaggagaccagcctacacagtccatcaaatacatctgcccctcatagccaaggaggtattccacctcctaccggaatataattaaagggagaaatacactgtatgaagtatatgttgatactatgacatgttgccaacaccttgagaagcattatttgtttctaataaaagtaatggctttgtcaatatattggtgggtttaaaactttgctgcttttttacataaagcctgtgcctttcctagaaagttaagatgtaaatgtattctcacatgtaaatttgaaagttcaggggtctattatgaaatgatacacatttttaaatgaaccataatttttttcactaagctgtttgccttccaaagtgtttacaccttaagccttaacatgtatcttcattcagaaaacagttatattgtcataccatagtaggaagaaaaacctttatttggaatatacactactgtaagtttgtacagatcatatacctaccacctgtctttgcttaaagagccttgattacataaatatgtaggaaaaaacatattgagttcaaaatttatatctaacattgtttatgttatgatttttttttaattgcaaagactaggtgtatatttttttctgtttttctaaatgacccgtggtacttaataggtgtactaaaattgtgttgggagcagggatttggaaatttctgagagatgtgtagttaatttagtaattctgtttcatgagatatgatctgttatgctagtggtttaataggcttgctatgtaagtagaacgtggctcaactagatatctttatatgtatgggcatagtacagtaaaataatccaccgttttttacagaccctagtcaaagggttaaaaaaattaagattgctttccatgtttgaaatttaccattgagagtcaatgaagttgctattttgagtttagcattgatattgtgaaaataagtgcaatttggatttcatgtttcttaatattcattcttgtttcacaaatgaatgattaaggaattatgcatcataaaggaacctaagtgaggtatatgatgagtgtattgtctttgcacacacatataggtatattctgaatacaagcttattcacattttgcttcctaatctttttgttgtacagggattcaggtttcttattcttacaacatgattgtttatatgtgaagcacatcttgctgttgccttatttttgatgcttttattcatgacaagaattgtcaatataagaatgtatatcttttttgcaaccaatttaataaaggagttgaaagaaagagtgcactgattgttaatattacaaagaaaccttcatcttaaaggcattgagcagtgcaaaacagaactgattttcaaagcaggaaatagaatcacagttttaatgtttggcaaggaataaaacagacagaaatgctttggagactatggttctatccttttttcttccgacctcatttagaaaatacttatttgcaactcttagattgttttcctgatataccttttctcattaattgtctaattaactagcaaagattcctgcttaagagtgtgtgctctgcaaccaaactgcctagatttgaatcttgtctacaccacttactagctgtttaact

SEQ ID NO: 1201 - DNA, 2520 bp, Homo sapiens
agcgcggcgcgggcccaacgagcgcacgcgtacacgcgtgcgcaggggaagaccgagtgccaggggctgaaccgcagggaagggggcgcggcgcacgcagtatggcgcccaacatctacttggttcgccagcggatcagtcgactcggccagaggatgtccggcttccagatcaacctcaacccgctcaaggagccactcggcttcatcaaggtcctcgagtggattgcttctatctttgcttttgccacctgtggaggttttaagggccaaacagaaattcaagtgaattgtcctcctgcagttactgagaataaaactgttacagctacttttggttatccattcaggttgaatgaggcatcatttcagccacctccaggtgtaaacatatgtgatgtaaattggaaagattacgtcctcataggcgattactcttcttctgcacaattctatgttacctttgcagtctttgtgttcctgtactgcattgctgcccttctgctttatgttggctacacgagtctgtatctggatagtcgtaaacttcctatgatagactttgttgttacacttgttgccacttttttgtggttggtgagcacttcagcctgggctaaagctctgacagatattaaaatagctactggtcacaatattattgatgaacttccgccttgtaagaagaaagcagtactgtgttactttggctctgtgaccagtatgggatccctaaatgtatctgtgatatttggctttctaaatatgatactctggggaggaaatgcttggtttgtgtacaaggagaccagcctacacagtccatcaaatacatctgcccctcatagccaaggaggtattccacctcctaccggaatataattaaagggagaaatacactgtatgaagtatatgttgatactatgacatgttgccaacaccttgagaagcattatttgtttctaataaaagtaatggctttgtcaatatattggtgggtttaaaactttgctgcttttttacataaagcctgtgcctttcctagaaagttaagatgtaaatgtattctcacatgtaaatttgaaagttcaggggtctattatgaaatgatacacatttttaaatgaaccataatttttttcactaagctgtttgccttccaaagtgtttacaccttaagccttaacatgtatcttcattcagaaaacagttatattgtcataccatagtaggaagaaaaacctttatttggaatatacactactgtaagtttgtacagatcatatacctaccacctgtctttgcttaaagagccttgattacataaatatgtaggaaaaaacatattgagttcaaaatttatatctaacattgtttatgttatgatttttttttaattgcaaagactaggtgtatatttttttctgtttttctaaatgacccgtggtacttaataggtgtactaaaattgtgttgggagcagggatttggaaatttctgagagatgtgtagttaatttagtaattctgtttcatgagatatgatctgttatgctagtggtttaataggcttgctatgtaagtagaacgtggctcaactagatatctttatatgtatgggcattactcttagtgatatttgtttcctgtcctttgttgctcatgctgtttaagtgcaggctgagacccagcctctttgtaagtacagtaaaataatccaccgttttttacagaccctagtcaaagggttaaaaaaattaagattgctttccatgtttgaaatttaccattgagagtcaatgaagttgctattttgagtttagcattgatattgtgaaaataagtgcaatttggatttcatgtttcttaatattcattcttgtttcacaaatgaatgattaaggaattatgcatcataaaggaacctaagtgaggtatatgatgagtgtattgtctttgcacacacatataggtatattctgaatacaagcttattcacattttgcttcctaatctttttgttgtacagggattcaggtttcttattcttacaacatgattgtttatatgtgaagcacatcttgctgttgccttatttttgatgcttttattcatgacaagaattgtcaatataagaatgtatatcttttttgcaaccaatttaataaaggagttgaaagaaagagtgcactgattgttaatattacaaagaaaccttcatcttaaaggcattgagcagtgcaaaacagaactgattttcaaagcaggaaatagaatcacagttttaatgtttggcaaggaataaaacagacagaaatgctttggagactatggttctatccttttttcttccgacctcatttagaaaatacttatttgcaactcttagattgttttcctgatataccttttctcattaattgtctaattaactagcaaagattcctgcttaagagtgtgtgctctgcaaccaaactgcctagatttgaatcttgtctacaccacttactagctgtttaact

SEQ ID NO: 1202 - DNA, 2483 bp, Homo sapiens
cgagcccggccagcgcgccagccccgcctgcccttcctcgccaccgggctgctctggtctcgtcggtcccctcctccgccccgtcgtcctgactctctctccctcctttcctcagaggatgtccggcttccagatcaacctcaacccgctcaaggagccactcggcttcatcaaggtcctcgagtggattgcttctatctttgcttttgccacctgtggaggttttaagggccaaacagaaattcaagtgaattgtcctcctgcagttactgagaataaaactgttacagctacttttggttatccattcaggttgaatgaggcatcatttcagccacctccaggtgtaaacatatgtgatgtaaattggaaagattacgtcctcataggcgattactcttcttctgcacaattctatgttacctttgcagtctttgtgttcctgtactgcattgctgcccttctgctttatgttggctacacgagtctgtatctggatagtcgtaaacttcctatgatagactttgttgttacacttgttgccacttttttgtggttggtgagcacttcagcctgggctaaagctctgacagatattaaaatagctactggtcacaatattattgatgaacttccgccttgtaagaagaaagcagtactgtgttactttggctctgtgaccagtatgggatccctaaatgtatctgtgatatttggctttctaaatatgatactctggggaggaaatgcttggtttgtgtacaaggagaccagcctacacagtccatcaaatacatctgcccctcatagccaaggaggtattccacctcctaccggaatataattaaagggagaaatacactgtatgaagtatatgttgatactatgacatgttgccaacaccttgagaagcattatttgtttctaataaaagtaatggctttgtcaatatattggtgggtttaaaactttgctgcttttttacataaagcctgtgcctttcctagaaagttaagatgtaaatgtattctcacatgtaaatttgaaagttcaggggtctattatgaaatgatacacatttttaaatgaaccataatttttttcactaagctgtttgccttccaaagtgtttacaccttaagccttaacatgtatcttcattcagaaaacagttatattgtcataccatagtaggaagaaaaacctttatttggaatatacactactgtaagtttgtacagatcatatacctaccacctgtctttgcttaaagagccttgattacataaatatgtaggaaaaaacatattgagttcaaaatttatatctaacattgtttatgttatgatttttttttaattgcaaagactaggtgtatatttttttctgtttttctaaatgacccgtggtacttaataggtgtactaaaattgtgttgggagcagggatttggaaatttctgagagatgtgtagttaatttagtaattctgtttcatgagatatgatctgttatgctagtggtttaataggcttgctatgtaagtagaacgtggctcaactagatatctttatatgtatgggcattactcttagtgatatttgtttcctgtcctttgttgctcatgctgtttaagtgcaggctgagacccagcctctttgtaagtacagtaaaataatccaccgttttttacagaccctagtcaaagggttaaaaaaattaagattgctttccatgtttgaaatttaccattgagagtcaatgaagttgctattttgagtttagcattgatattgtgaaaataagtgcaatttggatttcatgtttcttaatattcattcttgtttcacaaatgaatgattaaggaattatgcatcataaaggaacctaagtgaggtatatgatgagtgtattgtctttgcacacacatataggtatattctgaatacaagcttattcacattttgcttcctaatctttttgttgtacagggattcaggtttcttattcttacaacatgattgtttatatgtgaagcacatcttgctgttgccttatttttgatgcttttattcatgacaagaattgtcaatataagaatgtatatcttttttgcaaccaatttaataaaggagttgaaagaaagagtgcactgattgttaatattacaaagaaaccttcatcttaaaggcattgagcagtgcaaaacagaactgattttcaaagcaggaaatagaatcacagttttaatgtttggcaaggaataaaacagacagaaatgctttggagactatggttctatccttttttcttccgacctcatttagaaaatacttatttgcaactcttagattgttttcctgatataccttttctcattaattgtctaattaactagcaaagattcctgcttaagagtgtgtgctctgcaaccaaactgcctagatttgaatcttgtctacaccacttactagctgtttaact

SEQ ID NO: 1203 - DNA, 2183 bp, Homo sapiens
gagcgcacgcgtacacgcgtgcgcaggggaagaccgagtgccaggggctgaaccgcagggaagggggcgcggcgcacgcagtatggcgcccaacatctacttggttcgccagcggatcagtcgactcggccagaggatgtccggcttccagatcaacctcaacccgctcaaggagccactcggcttcatcaaggtcctcgagtggattgcttctatctttgcttttgccacctgtggaggttttaagggccaaacagaaattcaagtgaattgtcctcctgcagttactgagaataaaactgttacagctacttttggttatccattcaggttgaatgaggcatcatttcagccacctccaggtgtaaacatatgtgatgtaaattggaaagattacgtcctcataggcgattactcttcttctgcacaattctatgttacctttgcagtctttgtgttcctgtactgcattgctgcccttctgctttatgttggctacacgagtctgtatctggatagtcgtaaacttcctatgatagactttgttgttacacttgttgccacttttttgtggttggtgagcacttcagcctgggctaaagctctgacagatattaaaatagctactggtcacaatattattgatgaacttccgccttgtaagaagaaagcagtactgtgttactttggctctgtgaccagtatgggatccctaaatgtatctgtgatatttggctttctaaatatgatactctggggaggaaatgcttggtttgtgtacaaggagaccagcctacacagtccatcaaatacatctgcccctcatagccaaggaggtattccacctcctaccggaatataattaaagggagaaatacactgtatgaagtatatgttgatactatgacatgttgccaacaccttgagaagcattatttgtttctaataaaagtaatggctttgtcaatatattggtgggtttaaaactttgctgcttttttacataaagcctgtgcctttcctagaaagttaagatgtaaatgtattctcacatgtaaatttgaaagttcaggggtctattatgaaatgatacacatttttaaatgaaccataatttttttcactaagctgtttgccttccaaagtgtttacaccttaagccttaacatgtatcttcattcagaaaacagttatattgtcataccatagtaggaagaaaaacctttatttggaatatacactactgtaagtttgtacagatcatatacctaccacctgtctttgcttaaagagccttgattacataaatatgtaggaaaaaacatattgagttcaaaatttatatctaacattgtttatgttatgatttttttttaattgcaaagactaggtgtatatttttttctgtttttctaaatgacccgtggtacttaataggtgtactaaaattgtgttgggagcagggatttggaaatttctgagagatgtgtagttaatttagtaattctgtttcatgagatatgatctgttatgctagtggtttaataggcttgctatgtaagtagaacgtggctcaactagatatctttatatgtatgggcattactcttagtgatatttgtttcctgtcctttgttgctcatgctgtttaagtgcaggctgagacccagcctctttgtaagtacagtaaaataatccaccgttttttacagaccctagtcaaagggttaaaaaaattaagattgctttccatgtttgaaatttaccattgagagtcaatgaagttgctattttgagtttagcattgatattgtgaaaataagtgcaatttggatttcatgtttcttaatattcattcttgtttcacaaatgaatgattaaggaattatgcatcataaaggaacctaagtgaggtatatgatgagtgtattgtctttgcacacacatataggtatattctgaatacaagcttattcacattttgcttcctaatctttttgttgtacagggattcaggtttcttattcttacaacatgattgtttatatgtgaagcacatcttgctgttgccttatttttgatgcttttattcatgacaagaattgtcaatataagaatgtatatcttttttgcaaccaatttaataaaggagttgaaagaaaaaaaaaaaaaaaaaaaaaaaa

SEQ ID NO: 1204 - DNA, 2539 bp, Homo sapiens
ggatcagcccaaaggtaggctcaggctccgacggtggcccgcgggggtcacgaggcttcgtagtggaggaacgggtttggcgtgtgggacgcagctgcctctgtactggggagtcacggagtggccgggctccagggacatggcggcggcctctgcggtgtcggtgctgctggtggcggcggagaggaaccggtggcatcgtctcccgagcctgctcctgccgccgaggacatgggtgtggaggcaaagaaccatgaagtacacaacagccacaggaagaaacattaccaaggtcctcattgcaaacagaggagaaattgcctgcagggtgatgcgcacagccaaaaaactgggtgtacagactgtggcggtttatagtgaggctgacagaaattccatgcatgtagatatggcagatgaagcatattccatcggccccgctccctcccagcagagctacctatctatggagaaaatcattcaagtggccaagacctctgctgcacaggctatccatccaggatgcggttttctttcagaaaacatggaatttgctgaactttgtaagcaagaaggaattatttttataggccctcctccatctgcaattagagacatgggtataaagagcacatccaaatccataatggctgctgctggagtacctgttgtggagggttatcatggtgaggaccaatcagaccagtgcctgaaggaacacgccaggagaattggctatcctgtcatgattaaagccgtccggggtggaggaggaaaaggaatgaggattgttagatcagaacaagaatttcaagaacagttagagtcagcacggagagaagctaagaagtctttcaatgatgatgctatgctgatcgagaagtttgtagacacaccgaggcatgtagaagtccaggtgtttggtgatcaccatggcaatgctgtgtacttgtttgaaagagactgtagtgtgcagaggcgacatcagaagatcattgaggaggccccagcgcctggtattaaatctgaagtaagaaaaaagctgggagaagctgcagtcagagctgctaaagctgtaaattatgttggagcagggactgtggagtttattatggactcaaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggccatgccttcgaagctagaatatatgcagaagatcctagcaataacttcatgcctgtggcaggcccattagtgcacctctctactcctcgagcagacccttccaccaggattgaaactggagtacggcaaggagacgaagtttccgtgcattatgaccccatgattgcgaagctggtcgtgtgggcagcagatcgccaggcggcattgacaaaactgaggtacagccttcgtcagtacaatattgttggactgcccaccaacattgacttcttactcaacctgtctggccacccagagtttgaagctgggaacgtgcacactgatttcatccctcaacaccacaaacagttgttgctcagtcggaaggctgcagccaaagagtctttatgccaggcagccctgggtctcatcctcaaggagaaagccatgaccgacactttcactcttcaggcacatgatcaattctctccattttcgtctagcagtggaagaagactgaatatctcgtataccagaaacatgactcttaaagatggtaaaaacaatgtagccatagctgtaacgtataaccatgatgggtcttatagcatgcagattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaactcagggcggccccttagctcctatgactggaaccattgaaaaggtgtttgtcaaagctggagacaaagtgaaagcgggagattccctcatggttatgatcgccatgaagatggagcataccataaagtctccaaaggatggcacagtaaagaaagtgttctacagagaaggtgctcaggccaacagacacactcctttagtcgagtttgaggaggaagaatcagacaaaagggaatcggaataaactccagcaaggaaatggccagttaagtagtgtcttctctctccaccaaaaagaggaagtgcctccagcttttctgggggtctcataaagagcagttttactaaatgattgtatgcttatgctgaacacctttcatattggagaatcatgcatttgggtcactaattatctcaaaatatttcatactaataaagttgaattattttttattggaagccaatg

SEQ ID NO: 1205 - DNA, 2519 bp, Homo sapiens
aggctcaggctccgacggtggccggcgggggtcacgaggcttcgtagtggaggaacgggtttggcgtgtgggacgcagctgcctctgtactggggagtcacggagtggccgggctccagggacatggcggcggcctctgcggtgtcggtgctgctggtggcggcggagaggaaccggtggcatcgtctcccgagcctgctcctgccgccgaggacatgggtgtggaggcaaagaaccatgaagtacacaacagccacaggaagaaacattaccaaggtcctcattgcaaacagaggagaaattgcctgcagggtgatgcgcacagccaaaaaactgggtgtacagactgtggcggtttatagtgaggctgacagaaattccatgcatgtagatatggcagatgaagcatattccatcggccccgctccctcccagcagagctacctatctatggagaaaatcattcaagtggccaagacctctgctgcacaggctatccatccaggatgcggttttctttcagaaaacatggaatttgctgaactttgtaagcaagaaggaattatttttataggccctcctccatctgcaattagagacatgggtataaagagcacatccaaatccataatggctgctgctggagtacctgttgtggagggttatcatggtgaggaccaatcagaccagtgcctgaaggaacacgccaggagaattggctatcctgtcatgattaaagccgtccggggtggaggaggaaaaggaatgaggattgttagatcagaacaagaatttcaagaacagttagagtcagcacggagagaagctaagaagtctttcaatgatgatgctatgctgatcgagaagtttgtagacacaccgaggcatgtagaagtccaggtgtttggtgatcaccatggcaatgctgtgtacttgtttgaaagagactgtagtgtgcagaggcgacatcagaagatcattgaggaggccccagcgcctggtattaaatctgaagtaagaaaaaagctgggagaagctgcagtcagagctgctaaagctgtaaattatgttggagcagggactgtggagtttattatggactcaaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggccatgccttcgaagctagaatatatgcagaagatcctagcaataacttcatgcctgtggcaggcccattagtgcacctctctactcctcgagcagacccttccaccaggattgaaactggagtacggcaaggagacgaagtttccgtgcattatgaccccatgattgcgaagctggtcgtgtgggcagcagatcgccaggcggcattgacaaaactgaggtacagccttcgtcagtacaatattgttggactgcccaccaacattgacttcttactcaacctgtctggccacccagagtttgaagctgggaacgtgcacactgatttcatccctcaacaccacaaacagttgttgctcagtcggaaggctgcagccaaagagtctttatgccaggcagccctgggtctcatcctcaaggagaaagccatgaccgacactttcactcttcaggcacatgatcaattctctccattttcgtctagcagtggaagaagactgaatatctcgtataccagaaacatgactcttaaagatggtaaaaacaatgtagccatagctgtaacgtataaccatgatgggtcttatagcatgcagattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaactcagggcggccccttagctcctatgactggaaccattgaaaaggtgtttgtcaaagctggagacaaagtgaaagcgggagattccctcatggttatgatcgccatgaagatggagcataccataaagtctccaaaggatggcacagtaaagaaagtgttctacagagaaggtgctcaggccaacagacacactcctttagtcgagtttgaggaggaagaatcagacaaaagggaatcggaataaactccagcaaggaaatggccagttaagtagtgtcttctctctccaccaaaaagaggaagtgcctccagcttttctgggggtctcataaagagcagttttactaaatgattgtatgcttatgctgaacacctttcatattggagaatcatgcatttgggtcactaattatctcaaaatatttcatactaataaagttgaattattttttattggaagcc

SEQ ID NO: 1206 - DNA, 3208 bp, Homo sapiens
cccgtgattcattcacagcggcagacgagcgccaggaaagggttatttgatctgatccctcaagttccggaggcagcagtatcaagataaagaggaagttgtcttatggatgaatactgttgggccctaccataatcgtcaagaaacatataagtacttttcacttccattctgtgtggggtcaaaaaaaagtatcagtcattaccatgaaactctgggagaagcacttcaaggggttgaattggaatttagtggtctggatattaaatttaaagatgatgtgatgccagccacttactgtgaaattgatttagataaagaaaagagagatgcatttgtatatgccataaaaaatcattactggtaccagatgtacatagatgatttaccaatatggggtattgttggtgaggctgatgaaaatggagaagattactatctttggacctataaaaaacttgaaataggttttaatggaaatcgaattgttgatgttaatctaactagtgaaggaaaggtgaaactggttccaaatactaaaatccagatgtcatattcagtaaaatggaaaaagtcagatgtgaaatttgaagatcgatttgacaaatatcttgatccgtccttttttcaacatcggattcattggttttcaattttcaactccttcatgatggtgatcttcttggtgggcttagtttcaatgattttaatgagaacattaagaaaagattatgctcggtacagtaaagaggaagaaatggatgatatggatagagacctaggagatgaatatggatggaaacaggtgcatggagatgtatttagaccatcaagtcacccactgatattttcctctctgattggttctggatgtcagatatttgctgtgtctctcatcgttattattgttgcaatgatagaagatttatatactgagaggggatcaatgctcagtacagccatatttgtctatgctgctacgtctccagtgaatggttattttggaggaagtctgtatgctagacaaggaggaaggagatggataaagcagatgtttattggggcattccttatcccagctatggtgtgtggcactgccttcttcatcaatttcatagccatttattaccatgcttcaagagccattccttttggaacaatggtggccgtttgttgcatctgtttttttgttattcttcctctaaatcttgttggtacaatacttggccgaaatctgtcaggtcagcccaactttccttgtcgtgtcaatgctgtgcctcgtcctataccggagaaaaaatggttcatggagcctgcggttattgtttgcctgggtggaattttaccttttggttcaatctttattgaaatgtatttcatcttcacgtctttctgggcatataagatctattatgtctatggcttcatgatgctggtgctggttatcctgtgcattgtgactgtctgtgtgactattgtgtgcacatattttctactaaatgcagaagattaccggtggcaatggacaagttttctctctgctgcatcaactgcaatctatgtttacatgtattccttttactactattttttcaaaacaaagatgtatggcttatttcaaacatcattttactttggatatatggcggtatttagcacagccttggggataatgtgtggagcgattggttacatgggaacaagtgcctttgtccgaaaaatctatactaatgtgaaaattgactagagacccaagaaaacctggaactttggatcaatttctttttcataggggtggaacttgcacagcaaaaacaaacaaacgcaagaagagatttgggctttaacacactgggtactttgtgggtctctctttcgtcggtggcttaaagtaacatctatttccattgatcctaggttcttcctgactgctttctccaactgttcacagcaaatgcttggattttatgcagtaggcattactacagtacatggctaatcttcccaaaaactagctcattaaagatgaaatagaccagctctcttcagtgaagaggacaaatagtttatttaaagcatttgttccaataaaataaatagagggaaacttggatgctaaaattacttttttcctcttatttttactgccattgtcgacctattgtgggacatttttatatattgaatctgggttcttttttgactttttttttttcccaatccaacagcatccttttttttaaaagagagaattagaaaatattaaatcctgcatgtaatatatctgctgtcatcttagttggaccaacttcccatttatttatcttaaaactatacagttacatcttaattccatccaaagaagatacagtttgaagacagaagtgtactctctacaatgcaatttactgtacagttagaaagcaaagtgttaaatggagaagatacttgtttttattaaacattttgagatttagataaactacattttaactgaatgtctaaagtgattatcttttttccccccaagttagtcttaaatcttttgggtttgaatgaaggttttacataagaaattattaaaaacaaggggggtgggtaataaatgtatataacattaaataatgtaacgtaggtgtagattcccaaatgcatttggatgtacagatcgactacagagtacttttttcttatgatgattggtgtagaaatgtgtgatttgggtgggcttttacatcttgcctaccattgcatgaaacattggggtttcttcaaaatgtgtgtgtcatacttcttttgggaggggggttgttttcttctgtttattttctgagactcctacaggagccaaatttgtaatttagagacacttaattttgttaatcctgtctgggacacttaagtaacatctaaagcattattgctttagaatgttcaaataaaatttcctgaccaaattgttttgtggaaatagatgtgtttgcaatttgaagatatctttctgtccagaaggcaaaattaccgaatgccatttttaaaagtatgctataaactatgctactctcatacaggggacccgtattttaaaatctccagacttgcttacatctagattatccagcacaatcataaagtgaatgacaaaccctttgaatgaaattgtggcacaaaatctgttcaggttggtgtaccgtgtaaagtggggatg

SEQ ID NO: 1207 - DNA, 6130 bp, Homo sapiens
gaggcgcggggggcgggggaggctcaggagcgggcggtgacggcgacggcggcggcagaggaggcagcggctgggccgggccccgtgcgtctgtccgcgccccgtggatgcgaatcggccgcggcggaggcggcggcggcggaggaggcggcggcgggaggaggagtcggtgagccggctccgggccggaggggcgcggaggatgaggccgctgcctggcgctcttggcgtggcggcggccgccgcgctgtggctgctgctgctgctgctgccccggacccgggcggacgagcacgaacacacgtatcaagataaagaggaagttgtcttatggatgaatactgttgggccctaccataatcgtcaagaaacatataagtacttttcacttccattctgtgtggggtcaaaaaaaagtatcagtcattaccatgaaactctgggagaagcacttcaaggggttgaattggaatttagtggtctggatattaaatttaaagatgatgtgatgccagccacttactgtgaaattgatttagataaagaaaagagagatgcatttgtatatgccataaaaaatcattactggtaccagatgtacatagatgatttaccaatatggggtattgttggtgaggctgatgaaaatggagaagattactatctttggacctataaaaaacttgaaataggttttaatggaaatcgaattgttgatgttaatctaactagtgaaggaaaggtgaaactggttccaaatactaaaatccagatgtcatattcagtaaaatggaaaaagtcagatgtgaaatttgaagatcgatttgacaaatatcttgatccgtccttttttcaacatcggattcattggttttcaattttcaactccttcatgatggtgatcttcttggtgggcttagtttcaatgattttaatgagaacattaagaaaagattatgctcggtacagtaaagaggaagaaatggatgatatggatagagacctaggagatgaatatggatggaaacaggtgcatggagatgtatttagaccatcaagtcacccactgatattttcctctctgattggttctggatgtcagatatttgctgtgtctctcatcgttattattgttgcaatgatagaagatttatatactgagaggggatcaatgctcagtacagccatatttgtctatgctgctacgtctccagtgaatggttattttggaggaagtctgtatgctagacaaggaggaaggagatggataaagcagatgtttattggggcattccttatcccagctatggtgtgtggcactgccttcttcatcaatttcatagccatttattaccatgcttcaagagccattccttttggaacaatggtggccgtttgttgcatctgtttttttgttattcttcctctaaatcttgttggtacaatacttggccgaaatctgtcaggtcagcccaactttccttgtcgtgtcaatgctgtgcctcgtcctataccggagaaaaaatggttcatggagcctgcggttattgtttgcctgggtggaattttaccttttggttcaatctttattgaaatgtatttcatcttcacgtctttctgggcatataagatctattatgtctatggcttcatgatgctggtgctggttatcctgtgcattgtgactgtctgtgtgactattgtgtgcacatattttctactaaatgcagaagattaccggtggcaatggacaagttttctctctgctgcatcaactgcaatctatgtttacatgtattccttttactactattttttcaaaacaaagatgtatggcttatttcaaacatcattttactttggatatatggcggtatttagcacagccttggggataatgtgtggagcgattggttacatgggaacaagtgcctttgtccgaaaaatctatactaatgtgaaaattgactagagacccaagaaaacctggaactttggatcaatttctttttcataggggtggaacttgcacagcaaaaacaaacaaacgcaagaagagatttgggctttaacacactgggtactttgtgggtctctctttcgtcggtggcttaaagtaacatctatttccattgatcctaggttcttcctgactgctttctccaactgttcacagcaaatgcttggattttatgcagtaggcattactacagtacatggctaatcttcccaaaaactagctcattaaagatgaaatagaccagctctcttcagtgaagaggacaaatagtttatttaaagcatttgttccaataaaataaatagagggaaacttggatgctaaaattacatgaataggaatcttcctggcacttagtgtttctatgttattgaaaaatgatgttccagaaagattacttttttcctcttatttttactgccattgtcgacctattgtgggacatttttatatattgaatctgggttcttttttgactttttttttttcccaatccaacagcatccttttttttaaaagagagaattagaaaatattaaatcctgcatgtaatatatctgctgtcatcttagttggaccaacttcccatttatttatcttaaaactatacagttacatcttaattccatccaaagaagatacagtttgaagacagaagtgtactctctacaatgcaatttactgtacagttagaaagcaaagtgttaaatggagaagatacttgtttttattaaacattttgagatttagataaactacattttaactgaatgtctaaagtgattatcttttttccccccaagttagtcttaaatcttttgggtttgaatgaaggttttacataagaaattattaaaaacaaggggggtgggtaataaatgtatataacattaaataatgtaacgtaggtgtagattcccaaatgcatttggatgtacagatcgactacagagtacttttttcttatgatgattggtgtagaaatgtgtgatttgggtgggcttttacatcttgcctaccattgcatgaaacattggggtttcttcaaaatgtgtgtgtcatacttcttttgggaggggggttgttttcttctgtttattttctgagactcctacaggagccaaatttgtaatttagagacacttaattttgttaatcctgtctgggacacttaagtaacatctaaagcattattgctttagaatgttcaaataaaatttcctgaccaaattgttttgtggaaatagatgtgtttgcaatttgaagatatctttctgtccagaaggcaaaattaccgaatgccatttttaaaagtatgctataaactatgctactctcatacaggggacccgtattttaaaatctccagacttgcttacatctagattatccagcacaatcataaagtgaatgacaaaccctttgaatgaaattgtggcacaaaatctgttcaggttggtgtaccgtgtaaagtggggatggggtaaaagtggttaacgtactgttggatcaacaaataaaggttacagttttgtaagagaagtgatttgaatacatttttctggaactattcataatatgaagttttcctagaaccactgagtttctagtttaatagtttgctatgcaaatgaccacctaaaacaatactttatattgttatttttagaaagactcaaaacacctgtatttaaaccttaatatgaaaatcatgcaattaatagttacacaagatgttttcattacaaaatatgtacctatatattgatggactctacatcctatattgtgacatgtaagtcctttaaaaggtgaaaagtatgatttcttaccacttaagtatgattgatatgatccaacaaatttgatcagaagctgtaggtaaatcctcttctgaagccaaaatggtatattaaatataatttattggtacttccattttctcttccttcttacttgcctttaagatcttataaaaaagaaactaaaagttaatatttagttgcctatattatgtaaccttttaactatatataaagtacttttttggtttctttctcaccacttttattcaaaagtacttttaacataccaatacatagtctgtctgatgggagtataaattggacagtaaggttttgtcttaataaaatgaaatttgtttctcatgatatgaatcttgcaggtaagatgtagggtttattgaaaatgtgtgggttaaatgctttcaggtacaccaattctttctactaaattgagctctatttgaagttctttggaatctgtggtgaaaaataattttctgatttccaaatacattaagagcattaaatgaatattaatcacctttaaagtcttttagaaaaggacttgtattggtttttggctgcatagaggggttgaataagtgtatgtatgtgtgtgcgtgtgtgtgtgtcttcttaaagaagatgtaattcacaaatagtttagctccctagcgctcagttgtagaatagaaaatagaacattattcaagttaattgaaaggtgaggtttttatacccccactaatgctgtgtatctgtctttcgtttgttaacattatttgcttaatttctttcaactcacactttggataatactatcaaaaactaaggctaaacattccttgtgtatctttaagcatgcttctcctgaaatttaactacattagtagttgacatttgtatacatatatcctaatacaagagtaggataaggtggaaatgtaatggcctgagggatggtgaagcattctttcagtatttttcatcatgttgggctcctagattgtactggggttgcccataaatcaaaccccatactcttagaattcattatattatggtgatatccgaacctagtgaatggtatgcttgggtgttttccattgagagtggatggacctctttataaagttggttgctgcaaaatccagttcttccaaaagccactttatttagggtttattcacaagtcatatccattttggtacagtgtttgtttcctaatatttattaaccaccttataccaaatgtcttgcaaagaaatgttattaaaaccttgaatttttacaaatgtaaaaaacaaaaagtgtattaatgtatttgttcaggaaaagctacataccgaagggcttttgtatatgaattctgtggtggggagacccatttgtaatctatatggcagttccatctgggttttaagtttagatttcaccgtgtcttagtgcttcattctattggtttattggaacatgtaataaataggagtagtgatgtattaaaacacaagtattcattaatgttttatatcttcactaaaattctatagttatgaaactattttatcaatcaaggtgttatatttcagtcagaagtgaaaatttatgaagagtatttggaagtgtgtacagaaataaactagacttacaggtaggctagatcagaacgttaacatatgaacctgcagaaatctggtaagacttaaattcagtgtgaggaataactctagttctctcctatgagcatttcctaaaagccatctgatttggcattcttactggagctgcagacagaaatctacaaagacaaaagtaaacaaaattaagttattattccactgttaggaatggaaataaacttgtgaagtctgtttattttgaagtattggtgaactaggcttgctaattgataactgcagcagtttgtgtttactccagttcatcagcttaggtcatttgaaagatataagagcttaaggcaagaaagaaataacatggaattctatttgaaggacaacagaacattcttggaaaagcagctccagttggtttttcagctgtcaaacttgaatgtgtaagtccccacagagcatggacagtcggtgcagagttccaaggaaacaattattgcctgatgaccacttccattttgtatacactctttggttcgtataggccatattccaactggctttttagtaatagaaatccagtatataatgtatcaaatacaattgaggttctaacctagtgtgttaatttatctgaatttggatttttaaaaagtaataaaaagttaaatgta

SEQ ID NO: 1208 - DNA, 3433 bp, Homo sapiens
gaggcgcggggggcgggggaggctcaggagcgggcggtgacggcgacggcggcggcagaggaggcagcggctgggccgggccccgtgcgtctgtccgcgccccgtggatgcgaatcggccgcggcggaggcggcggcggcggaggaggcggcggcgggaggaggagtcggtgagccggctccgggccggaggggcgcggaggatgaggccgctgcctggcgctcttggcgtggcggcggccgccgcgctgtggctgctgctgctgctgctgccccggacccgggcggacgagcacgaacacacgtatcaagataaagaggaagttgtcttatggatgaatactgttgggccctaccataatcgtcaagaaacatataagtacttttcacttccattctgtgtggggtcaaaaaaaagtatcagtcattaccatgaaactctgggagaagcacttcaaggggttgaattggaatttagtggtctggatattaaatttaaagatgatgtgatgccagccacttactgtgaaattgatttagataaagaaaagagagatgcatttgtatatgccataaaaaatcattactggtaccagatgtacatagatgatttaccaatatggggtattgttggtgaggctgatgaaaatggagaagattactatctttggacctataaaaaacttgaaataggttttaatggaaatcgaattgttgatgttaatctaactagtgaaggaaaggtgaaactggttccaaatactaaaatccagatgtcatattcagtaaaatggaaaaagtcagatgtgaaatttgaagatcgatttgacaaatatcttgatccgtccttttttcaacatcggattcattggttttcaattttcaactccttcatgatggtgatcttcttggtgggcttagtttcaatgattttaatgagaacattaagaaaagattatgctcggtacagtaaagaggaagaaatggatgatatggatagagacctaggagatgaatatggatggaaacaggtgcatggagatgtatttagaccatcaagtcacccactgatattttcctctctgattggttctggatgtcagatatttgctgtgtctctcatcgttattattgttgcaatgatagaagatttatatactgagaggggatcaatgctcagtacagccatatttgtctatgctgctacgtctccagtgaatggttattttggaggaagtctgtatgctagacaaggaggaaggagatggataaagcagatgtttattggggcattccttatcccagctatggtgtgtggcactgccttcttcatcaatttcatagccatttattaccatgcttcaagagccattccttttggaacaatggtggccgtttgttgcatctgtttttttgttattcttcctctaaatcttgttggtacaatacttggccgaaatctgtcaggtcagcccaactttccttgtcgtgtcaatgctgtgcctcgtcctataccggagaaaaaatggttcatggagcctgcggttattgtttgcctgggtggaattttaccttttggttcaatctttattgaaatgtatttcatcttcacgtctttctgggcatataagatctattatgtctatggcttcatgatgctggtgctggttatcctgtgcattgtgactgtctgtgtgactattgtgtgcacatattttctactaaatgcagaagattaccggtggcaatggacaagttttctctctgctgcatcaactgcaatctatgtttacatgtattccttttactactattttttcaaaacaaagatgtatggcttatttcaaacatcattttactttggatatatggcggtatttagcacagccttggggataatgtgtggagcgattggttacatgggaacaagtgcctttgtccgaaaaatctatactaatgtgaaaattgactagagacccaagaaaacctggaactttggatcaatttctttttcataggggtggaacttgcacagcaaaaacaaacaaacgcaagaagagatttgggctttaacacactgggtactttgtgggtctctctttcgtcggtggcttaaagtaacatctatttccattgatcctaggttcttcctgactgctttctccaactgttcacagcaaatgcttggattttatgcagtaggcattactacagtacatggctaatcttcccaaaaactagctcattaaagatgaaatagaccagctctcttcagtgaagaggacaaatagtttatttaaagcatttgttccaataaaataaatagagggaaacttggatgctaaaattacttttttcctcttatttttactgccattgtcgacctattgtgggacatttttatatattgaatctgggttcttttttgactttttttttttcccaatccaacagcatccttttttttaaaagagagaattagaaaatattaaatcctgcatgtaatatatctgctgtcatcttagttggaccaacttcccatttatttatcttaaaactatacagttacatcttaattccatccaaagaagatacagtttgaagacagaagtgtactctctacaatgcaatttactgtacagttagaaagcaaagtgttaaatggagaagatacttgtttttattaaacattttgagatttagataaactacattttaactgaatgtctaaagtgattatcttttttccccccaagttagtcttaaatcttttgggtttgaatgaaggttttacataagaaattattaaaaacaaggggggtgggtaataaatgtatataacattaaataatgtaacgtaggtgtagattcccaaatgcatttggatgtacagatcgactacagagtacttttttcttatgatgattggtgtagaaatgtgtgatttgggtgggcttttacatcttgcctaccattgcatgaaacattggggtttcttcaaaatgtgtgtgtcatacttcttttgggaggggggttgttttcttctgtttattttctgagactcctacaggagccaaatttgtaatttagagacacttaattttgttaatcctgtctgggacacttaagtaacatctaaagcattattgctttagaatgttcaaataaaatttcctgaccaaattgttttgtggaaatagatgtgtttgcaatttgaagatatctttctgtccagaaggcaaaattaccgaatgccatttttaaaagtatgctataaactatgctactctcatacaggggacccgtattttaaaatctccagacttgcttacatctagattatccagcacaatcataaagtgaatgacaaaccctttgaatgaaattgtggcacaaaatctgttcaggttggtgtaccgtgtaaagtggggatg

SEQ ID NO: 1209 - DNA, 1721 bp, Homo sapiens
ggtaagctcgcgccgccgcgtcagctcagcgctgggtctctcggtcccgcagccgtgaggaggacggtctgcatactcgctgcccgccggctccctcccccgcgtccctgcgaccgccgcggcgaagatggcctcaggagtgcaagtagctgatgaagtatgtcgcattttttatgacatgaaagttcgtaaatgctccacaccagaagaaatcaagaaaagaaagaaggctgtcattttttgtctcagtgcagacaaaaagtgcatcattgtagaagaaggcaaagagatcttggttggagatgttggtgtaaccataactgatcctttcaagcattttgtgggaatgcttcctgaaaaagattgtcgctatgctttgtatgatgcaagctttgaaacaaaagaatccagaaaagaagagttgatgttttttttgtgggcaccagaactagcacctctgaaaagtaaaatgatctatgcaagctccaaggatgcaattaaaaagaaatttcaaggcataaaacatgaatgtcaagcaaatggaccagaagatctcaatcgggcttgtattgctgaaaagttaggtggatccttaattgtagcctttgaaggatgccctgtgtagattattcagtgccacaaattgaaagcttccatgtttaatgttatcctcttgctatataaataaagcaaatatatttaggccagggtctcactgagggggagctgtcttgtcatcttttagagtaaactattctataaacatatgcaaacagccctaaataaatctaaagtctaaagttttattgatgtgaaattaaattcttattggccaaatgcctgttttgatgagttgatttataaagatttttgttaagctcaggattttaaattacacagttcacaaacagtaaaggccatgtgaagagaattattacatctttattaacctcagcatttactttgtttcttttgcttaggaaattgctcataatctggttataattttggtccaaattctttattcttccttgagctaagcagaataatggaatataatatgtcttcataatataacaacactaatacactaatagtaagattaagttaggcagtcttctaccaaatgtgtaatggagattgcctcaaaattgtgtccacataatccacgctcatcttgcaaagcgctatttcaggcacatcattggaatacaggaagtagccctgcacctgccagtgagctcgccattcactgattggaagagtgacctggcatcttggaaatcattgtgtgtcttcaggagaatgtgcagtgtcttgtaacaactaattataatgcaaattagggctacattgtaatctgctttgttaatgaaaatgataaaacagaatattgacaagctaggacacctgtggtatctttaattgtatctccttcagaagtttgcttcttatggtataataaagtatggaagaatattgagtatatgtttactctgggcctgggagaacttaactttctagagcagtttgttgacttgtgtgcaatggggagaggtaccatgatgacactcacagggagccactgttcactgacacttggaagcggtcattgttaatatcacgggcgtaacactttgaacgatatagagatgcacaaacagttgaacttagaagtagcagtattggctttatgtaataaaggaagcatttttgactta

SEQ ID NO: 1210 - DNA, 859 bp, Homo sapiens
gcgttccgtcctgaggcgcgcccgccccggggtaagctcgcgccgccgcgtcagctcagcgctgggtctctcggtcccgcagccgtgaggaggacggtctgcatactcgctgcccgccggctccctcccccgcgtccctgcgaccgccgcggcgaagatggcctcaggagtgcaagtagctgatgaagtatgtcgcattttttatgacatgaaagttcgtaaatgctccacaccagaagaaatcaagaaaagaaagaaggctgtcattttttgtctcagtgcagacaaaaagtgcatcattgtagaagaaggcaaagagatcttggttggagatgttggtgtaaccataactgatcctttcaagcattttgtgggaatgcttcctgaaaaagattgtcgctatgctttgtatgatgcaagctttgaaacaaaagaatccagaaaagaagagttgatgttttttttgtgggcaccagaactagcacctctgaaaagtaaaatgatctatgcaagctccaaggatgcaattaaaaagaaatttcaaggcataaaacatgaatgtcaagcaaatggaccagaagatctcaatcgggcttgtattgctgaaaagttaggtggatccttaattgtagcctttgaaggatgccctgtgtagattattcagtgccacaaattgaaagcttccatgtttaatgttatcctcttgctatataaataaagcaaatatatttaggccagggtctcactgagggggagctgtcttgtcatcttttagagtaaactattctataaacatatgcaaacagccctaaataaatctaaagtctaaagttttaaaaaaaaaaaaaaaaaaaaaaaa

SEQ ID NO: 1211 - DNA, 1422 bp, Homo sapiens
cggtctgcatactcgctgcccgccggctccctcccccgcgtccctgcgaccgccgcggcgaacataggcctcaggagtgcaagtagctgatgaagtatgtcgcattttttatgacatgaaagttcgtaaatgctccacaccagaagaaatcaagaaaagaaagaaggctgtcattttttgtctcagtgcagacaaaaagtgcatcattgtagaagaaggcaaagagatcttggttggagatgttggtgtaaccataactgatcctttcaagcattttgtgggaatgcttcctgaaaaagattgtcgctatgctttgtatgatgcaagctttgaaacaaaagaatccagaaaagaagagttgatgttttttttgtgggcaccagaactagcacctctgaaaagtaaaatgatctatgcaagctccaaggatgcaattaaaaagaaatttcaaggcataaaacatgaatgtcaagcaaatggaccagaagatctcaatcgggcttgtattgctgaaaagttaggtggatccttaattgtagcctttgaaggatgccctgtgtagattattcagtgccacaaattgaaagcttccatgtttaatgttatcctcttgctatataaataaagcaaatatatttaggccagggtctcactgagggggagctgtcttgtcatcttttagagtaaactattctataaacatatgcaaacagccctaaataaatctaaagtctaaagttttattgatgtgaaattaaattcttattggccaaatgcctgttttgatgagttgatttataaagatttttgttaagctcaggattttaaattacacagttcacaaacagtaaaggccatgtgaagagaattattacatctttattaacctcagcatttactttgtttcttttgcttaggaaattgctcataatctggttataattttggtccaaattctttattcttccttgagctaagcagaataatggaatataatatgtcttcataatataacaacactaatacactaatagtaagattaagttaggcagtcttctaccaaatgtgtaatggagattgcctcaaaattgtgtccacataatccacgctcatcttgcaaagcgctatttcaggcacatcattggaatacaggaagtagccctgcacctgccagtgagctcgccattcactgattggaagagtgacctggcatcttggaaatcattgtgtgtcttcaggagaatgtgcagtgtcttgtaacaactaattataatgcaaattaggccactgttcactgacacttggaagcggtcattgttaatatcacgggcgtaacactttgaacgatatagagatgcacaaacagttgaacttagaagtagcagtattggctttatgtaataaaggaagcatttttgactt

SEQ ID NO: 1212 - DNA, 2542 bp, Homo sapiens
gcatgcgcgctcgcgctcccgccctctagctgcgctcggctgagtcagtcagtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaaagcctacctggacgtagacattactctgtcctcagaagctttccataattacatgaatgctgccatggtgcacatcaacagggccctgaaactcattattcgtctctttctggtagaagatctggttgactccttgaagctggctgtcttcatgtggctgatgacctatgttggtgctgtttttaacggaatcacccttctaattcttgctgaactgctcattttcagtgtcccgattgtctatgagaagtacaaggatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgcccttaagaagtcatgattaacttatgaaaaaattatttggggacaggagtgtgataccttccttggtttttttttgcagccctcaaatcctatcttcctgccccacaatgtgagcagctacccctgatactccttttctttaatgatttaactatcaacttgataaataacttataggtgatagtgataattcctgattccaagaatgccatctgataaaaaagaatagaaatggaaagtgggactgagagggagtcagcaggcatgctgcggtggcggtcactccctctgccactatccccagggaaggaaaggctccgccatttgggaaagtggtttctacgtcactggacaccggttctgagcattagtttgagaactcgttcccgaatgtgctttcctccctctcccctgcccacctcaagtttaataaataaggttgtacttttcttactataaaataaatgtctgtaactgctgtgcactgctgtaaacttgttagagaaaaaaataacctgcatgtgggctcctcagttattgagtttttgtgatcctatctcagtctgggggggaacattctcaagaggtgaaatacagaaagcctttttttcttgatcttttcccgagattcaaatctccgattcccatttgggggcaagtttttttcttcaccttcaatatgagaattcagcgaacttgaaagaaaaatcatctgtgagttccttcaggttctcactcatagtcatgatccttcagagggaatatgcactggcgagtttaaagtaagggctatgatatttgatggtcccaaagtacggcagctgcaaaaagtagtggaaggaaattgtctacgtgtcttggaaaaattagttaggaatttggatgggtaaaaggtacccttgccttactccatcttattttcttagccccctttgagtgttttaactggtttcatgtcctagtaggaagtgcattctccatcctcatcctctgccctcccaggaagtcagtgattgtctttttgggcttcccctccaaaggaccttctgcagtggaagtgccacatccagttcttttcttttgttgctgctgtgtttagataattgaagagatctttgtgccacacaggatttttttttttttttaagaaaaacctatagatgaaaaattactaatgaaactgtgtgtacgtgtctgtgcgtgcaacataaaaatacagtagcacctaaggagcttgaatcttggttcctgtaaaatttcaaattgatgtggtattaataaaaaaaaaaaaaacacaaacaaaaaaaaaaaaaaa

SEQ ID NO: 1213 - DNA, 2456 bp, Homo sapiens
tgcgcatgcgcgctcgcgctcccgccctctagctgcgctcggctgagtcagtcagtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaaagcctacctggacgtagacattactctgtcctcagaagctttccataattacatgaatgctgccatggtgcacatcaacagggccctgaaactcattattcgtctctttctggtagaagatctggttgactccttgaagctggctgtcttcatgtggctgatgacctatgttggtgctgtttttaacggaatcacccttctaattcttgctgaactgctcattttcagtgtcccgattgtctatgagaagtacaagacccagattgatcactatgttggcatcgcccgagatcagaccaagtcaattgttgaaaagatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgcccttaagaagtcatgattaacttatgaaaaaatatcctatcttcctgccccacaatgtgagcagctacccctgatactccttttctttaatgatttaactatcaacttgataaataacttataggtgatagtgataattcctgattccaagaatgccatctgataaaaaagaatagaaatggaaagtgggactgagagggagtcagcaggcatgctgcggtggcggtcactccctctgccactatccccagggaaggaaaggctccgccatttgggaaagtggtttctacgtcactggacaccggttctgagcattagtttgagaactcgttcccgaatgtgctttcctccctctcccctgcccacctcaagtttaataaataaggttgtacttttcttactataaaataaatgtctgtaactgctgtgcactgctgtaaacttgttagagaaaaaaataacctgcatgtgggctcctcagttattgagtttttgtgatcctatctcagtctgggggggaacattctcaagaggtgaaatacagaaagcctttttttcttgatcttttcccgagattcaaatctccgattcccatttgggggcaagtttttttcttcaccttcaatatgagaattcagcgaacttgaaagaaaaatcatctgtgagttccttcaggttctcactcatagtcatgatccttcagagggaatatgcactggcgagtttaaagtaagggctatgatatttgatggtcccaaagtacggcagctgcaaaaagtagtggaaggaaattgtctacgtgtcttggaaaaattagttaggaatttggatgggtaaaaggtacccttgccttactccatcttattttcttagccccctttgagtgttttaactggtttcatgtcctagtaggaagtgcattctccatcctcatcctctgccctcccaggaagtcagtgattgtctttttgggcttcccctccaaaggaccttctgcagtggaagtgccacatccagttcttttcttttttttaagaaaaacctatagatgaaaaattactaatgaaactgtgtgtacgtgtctgtgcgtgcaacataaaaatacagtagcacctaaggagcttgaatcttggttcctgtaaaatttcaaattgatgtggtattaat

SEQ ID NO: 1214 - DNA, 2560 bp, Homo sapiens
gttgcagccctctagctgcactcggctgagtcagtctgtcggagtctgtcctcagagcaggcagagtaaagggacttgaacgagccagttgccagattattctatttcccctccctctctcccgccccctatctcttttcacccttctcccaccctcgctcacgtagccatggcggagccatcggcggccactcagtccccttccatctcctcgtcgtcctccggagccgagacgtccgcatccggcggcagcggaagcccaggagcctgccctgccctggggacgaagagctgcagctcctcctgtgcggttcacgatctgcttttctggagagatgtaaagaagactgggtttgtctttgccaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccaatcaaagcctacctggacgtagacattactctgtcctcggaagctttccataattacatgaatgctgccgtggtgcacatcaacagggccctgaaactcattattcttctctttctagtagaagatctggttgactccttgaagcaggctgtcttcatgtggctgatgacctatgttggtgctttttttaacggaatcacccttctaattcttgctgaactgctcattttcagtgtcccgattgtctatgagaagtacaagacccagattgatcactatgttggcatcgcccgacatcagaccaagtcaattgttgaaaagatccaagcaaaactccctggaatcgccaaaaaaaaaggcagaataagtacatggaaccagaaatccaacagttactaaaacaccatttaatagttataacgtcgttgcttgtactgtgaacgaacatactcagtgtcagcttgagcctgcattccaagctttttttttaatttggtgttttctcccatcctttccctttaaccctcagtatcaagcacaaaaactgatggactgataaaagaactatcttagaactcagaagaagaaagaatcaaattcataggataagtcaacaccttaatggtggtagagcctttacctgtagcttgaaaggggaaagattggaggtaaaagagaaaatgaaagatagaacacctctgggtccttctatccagttttcagcactagtcttactcagctatccattatagttttgcccttaagaagtaatgattaacttatgaaaaaattatttggggacaggagtgtgatgccttccttgtttttgtttttttttttgcagccctcaaatcctatcttcctgccccacaatgtgagcagctactcctgatactccttttctttaatgatttaactttcaacttgatgaataacttataagtgatagtgataattcctgattccaagaatgccatctgataagaaagaatagaaatggaaagtgggactgagagggagtcagcaggaatgctgcagtggccgtcactccctctgccactatccccagggaaggaaaggctccgccatttgggcaagtggtttctacatcactggacaccagttctgagcgttagtttgagaactcgttcccgaatgtgctttcctccctctcccctgcccgcctcaagtttaataaatatggttgtacttttcttattataaaataaatgtctgtaactgctgtgcactgctgtaaacttgttagagaaaaaataacctgcatgtgggctcctcagttattgagttattgtgatcctatctcagtctgggggggaacattctcaagaggtgaaatacagaaagcctttttttcttgatcttttcccagttattcaaatgtccgattcccatttgggggcaagtttttttcttcaccttcaatatgaaaattcagcgaaattgaaagaaaaatcatctgtgagttccttcaggttctcactcatagtcatgatccttcagagggaatatgcactggcgagtttaaagtaagggctatgatatttgatggtcccaaagtacggcagctgcaaaaagtagtggaaggaaattgtctttctacgtgttttgggaaaattaattaggaatttggatgggtaaaaggtacccttgccttacttcatcttattttcttagccccctttgagtgttttaactggtttcatgtcctagtaggaagtgcattctccatcctcatcctctgccctcccaggaagtcagtgattgtctttttgggcttcccctccaaaggaccttctgcagtggaagagcctcatccagttattttcttttgttgctgctgtgtttagataattgaagagatctttgtgccacacaggatttttttttttaagaaaaacctgcagatgaaaaattactaatgaaactgtgtgtacgtgtctgtgcatgcaacataaaaatacagtagcacctaaggagcttgaatcttggttcctgtaaaattgcaaattgatgtggtattaataa

SEQ ID NO: 1215 - DNA, 2583 bp, Homo sapiens
gcatgcgcgctcgcgctcccgccctctagctgcgctcggctgagtcagtcagtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaaagcctacctggacgtagacattactctgtcctcagaagctttccataattacatgaatgctgccatggtgcacatcaacagggccctgaaactcattattcgtctctttctggtagaagatctggttgactccttgaagctggctgtcttcatgtggctgatgacctatgttggtgctgtttttaacggaatcacccttctaattcttgctgaactgctcattttcagtgtcccgattgtctatgagaagtacaagacccagattgatcactatgttggcatcgcccgagatcagaccaagtcaattgttgaaaagatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgcccttaagaagtcatgattaacttatgaaaaaattatttggggacaggagtgtgataccttccttggtttttttttgcagccctcaaatcctatcttcctgccccacaatgtgagcagctacccctgatactccttttctttaatgatttaactatcaacttgataaataacttataggtgatagtgataattcctgattccaagaatgccatctgataaaaaagaatagaaatggaaagtgggactgagagggagtcagcaggcatgctgcggtggcggtcactccctctgccactatccccagggaaggaaaggctccgccatttgggaaagtggtttctacgtcactggacaccggttctgagcattagtttgagaactcgttcccgaatgtgctttcctccctctcccctgcccacctcaagtttaataaataaggttgtacttttcttactataaaataaatgtctgtaactgctgtgcactgctgtaaacttgttagagaaaaaaataacctgcatgtgggctcctcagttattgagtttttgtgatcctatctcagtctgggggggaacattctcaagaggtgaaatacagaaagcctttttttcttgatcttttcccgagattcaaatctccgattcccatttgggggcaagtttttttcttcaccttcaatatgagaattcagcgaacttgaaagaaaaatcatctgtgagttccttcaggttctcactcatagtcatgatccttcagagggaatatgcactggcgagtttaaagtaagggctatgatatttgatggtcccaaagtacggcagctgcaaaaagtagtggaaggaaattgtctacgtgtcttggaaaaattagttaggaatttggatgggtaaaaggtacccttgccttactccatcttattttcttagccccctttgagtgttttaactggtttcatgtcctagtaggaagtgcattctccatcctcatcctctgccctcccaggaagtcagtgattgtctttttgggcttcccctccaaaggaccttctgcagtggaagtgccacatccagttcttttcttttgttgctgctgtgtttagataattgaagagatctttgtgccacacaggatttttttttttttttaagaaaaacctatagatgaaaaattactaatgaaactgtgtgtacgtgtctgtgcgtgcaacataaaaatacagtagcacctaaggagcttgaatcttggttcctgtaaaatttcaaattgatgtggtattaataaaaaaaaaaaaaaaaca

SEQ ID NO: 1216 - DNA, 2590 bp, Homo sapiens
tgcgcatgcgcgctcgcgctcccgccctctagctgcgctcggctgagtcagtcagtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaaagcctacctggacgtagacattactctgtcctcagaagctttccataattacatgaatgctgccatggtgcacatcaacagggccctgaaactcattattcgtctctttctggtagaagatctggttgactccttgaagctggctgtcttcatgtggctgatgacctatgttggtgctgtttttaacggaatcacccttctaattcttgctgaactgctcattttcagtgtcccgattgtctatgagaagtacaagacccagattgatcactatgttggcatcgcccgagatcagaccaagtcaattgttgaaaagatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgcccttaagaagtcatgattaacttatgaaaaaattatttggggacaggagtgtgataccttccttggtttttttttgcagccctcaaatcctatcttcctgccccacaatgtgagcagctacccctgatactccttttctttaatgatttaactatcaacttgataaataacttataggtgatagtgataattcctgattccaagaatgccatctgataaaaaagaatagaaatggaaagtgggactgagagggagtcagcaggcatgctgcggtggcggtcactccctctgccactatccccagggaaggaaaggctccgccatttgggaaagtggtttctacgtcactggacaccggttctgagcattagtttgagaactcgttcccgaatgtgctttcctccctctcccctgcccacctcaagtttaataaataaggttgtacttttcttactataaaataaatgtctgtaactgctgtgcactgctgtaaacttgttagagaaaaaaataacctgcatgtgggctcctcagttattgagtttttgtgatcctatctcagtctgggggggaacattctcaagaggtgaaatacagaaagcctttttttcttgatcttttcccgagattcaaatctccgattcccatttgggggcaagtttttttcttcaccttcaatatgagaattcagcgaacttgaaagaaaaatcatctgtgagttccttcaggttctcactcatagtcatgatccttcagagggaatatgcactggcgagtttaaagtaagggctatgatatttgatggtcccaaagtacggcagctgcaaaaagtagtggaaggaaattgtctacgtgtcttggaaaaattagttaggaatttggatgggtaaaaggtacccttgccttactccatcttattttcttagccccctttgagtgttttaactggtttcatgtcctagtaggaagtgcattctccatcctcatcctctgccctcccaggaagtcagtgattgtctttttgggcttcccctccaaaggaccttctgcagtggaagtgccacatccagttcttttcttttgttgctgctgtgtttagataattgaagagatctttgtgccacacaggattttttttttttttaagaaaaacctatagatgaaaaattactaatgaaactgtgtgtacgtgtctgtgcgtgcaacataaaaatacagtagcacctaaggagcttgaatcttggttcctgtaaaatttcaaattgatgtggtattaataaaaaaaaaaaaaacacaaacaa

SEQ ID NO: 1217 - DNA, 2597 bp, Homo sapiens
ccctctagctgcactcggctgagtcagtctgtcggagtctgtcctcagagcaggcagagtaaagggacttgaacgagccagttgccagattattctatttcccctccctctctcccgccccctatctcttttcacccttctcccaccctcgctcacgtagccatggcggagccatcggcggccactcagtccccttccatctcctcgtcgtcctccggagccgagacgtccgcatccggcggcagcggaagcccaggagcctgccctgccctggggacgaagagctgcagctcctcctgtgcggttcacgatctgcttttctggagagatgtaaagaagactgggtttgtctttgccaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccaatcaaagcctacctggacgtagacattactctgtcctcggaagctttccataattacatgaatgctgccgtggtgcacatcaacagggccctgaaactcattattcttctctttctagtagaagatctggttgactccttgaagcaggctgtcttcatgtggctgatgacctatgttggtgctttttttaacggaatcacccttctaattcttgctgaactgctcattttcagtgtcccgattgtctatgagaagtacaagacccagattgatcactatgttggcatcgcccgacatcagaccaagtcaattgttgaaaagatccaagcaaaactccctggaatcgccaaaaaaaaggcagaataagtacatggaaccagaaatgcaacagttactaaaacaccatttaatagttataacgtcgttgcttgtactgtgaacgaacatactcagtgtcagcttgagcctgcattccaagctttttttttaatttggtgttttctcccatcctttccctttaaccctcagtatcaagcacaaaaactgatggactgataaaagaactatcttagaactcagaagaagaaagaatcaaattcataggataagtcaacaccttaatggtggtagagcctttacctgtagcttgaaaggggaaagattggaggtaaaagagaaaatgaaagatagaacacctctgggtccttctatccagttttcagcactagtcttactcagctatccattatagttttgcccttaagaagtaatgattaacttatgaaaaaattatttggggacaggagtgtgatgccttccttgtttttgtttttttttttgcagccctcaaatcctatcttcctgccccacaatgtgagcagctactcctgatactccttttctttaatgatttaactttcaacttgatgaataacttataagtgatagtgataattcctgattccaagaatgccatctgataagaaagaatagaaatggaaagtgggactgagagggagtcagcaggaatgctgcagtggccgtcactccctctgccactatccccagggaaggaaaggctccgccatttgggcaagtggtttctacatcactggacaccagttctgagcgttagtttgagaactcgttcccgaatgtgctttcctccctctcccctgcccgcctcaagtttaataaatatggttgtacttttcttattataaaataaatgtctgtaactgctgtgcactgctgtaaacttgttagagaaaaaataacctgcatgtgggctcctcagttattgagttattgtgatcctatctcagtctgggggggaacattctcaagaggtgaaatacagaaagcctttttttcttgatcttttcccagttgttcttttcttgatcttttcccgagattcaaatgtccgattcccatttgggggcaagtttttttcttcaccttcaatatgaaaattcagcgaaattgaaagaaaaatcatctgtgagttccttcaggttctcactcatagtcatgatccttcagagggaatatgcactggcgagtttaaagtaagggctatgatatttgatggtcccaaagtacggcagctgcaaaaagtagtggaaggaaattgtctttctacgtgttttgggaaaattaattaggaatttggatgggtaaaaggtacccttgccttacttcatcttattttcttagccccctttgagtgttttaactggtttcatgtcctagtaggaagtgcattctccatcctcatcctctgccctcccaggaagtcagtgattgtctttttgggcttcccctccaaaggaccttctgcagtggaagagcctcatccagttattttcttttgttgctgctgtgtttagataattgaagagatctttgtgccacacaggatttttttttttaagaaaaacctgcagatgaaaaattactaatgaaactgtgtgtacgtgtctgtgcatgcaacataaaaatacagtagcacctaaggagcttgaatcttggttcctgtaaaattgcaaattgatgtggtattaataacacacacacacacacacaca

SEQ ID NO: 1218 - DNA, 5005 bp, Homo sapiens
atgcaggaattagagcagaaagaagaggcagcgggcgaggaggccaatgatggaggctcaggccacagcctaggccaggaaggccgtgagtctgcagcaggggccaaggcggactacatttcccgaagtgcaccgaggtgggcaggacccggaagtgagggtgtgagaggcctctctggaagttgtcccgggtgttcgccgctggagcccgggtcgagaggacgaggtgccgctgcctggagaatcctccgctgccgtcggctcccggagcccagccctttcctaacccaacccaacctagcccagtcccagccgccagcgcctgtccctgtcacggaccccagcgttaccatgcatcctgccgtcttcctatccttacccgacctcagatgctcccttctgctcctggtaacttgggtttttactcctgtaacaactgaaataacaagtcttgatacagagaatatagatgaaattttaaacaatgctgatgttgctttagtaaatttttatgctgactggtgtcgtttcagtcagatgttgcatccaatttttgaggaagcttccgatgtcattaaggaagaatttccaaatgaaaatcaagtagtgtttgccagagttgattgtgatcagcactctgacatagcccagagatacaggataagcaaatacccaaccctcaaattgtttcgtaatgggatgatgatgaagagagaatacaggggtcagcgatcagtgaaagcattggcagattacatcaggcaacaaaaaagtgaccccattcaagaaattcgggacttagcagaaatcaccactcttgatcgcagcaaaagaaatatcattggatattttgagcaaaaggactcggacaactatagagtttttgaacgagtagcgaatattttgcatgatgactgtgcctttctttctgcatttggggatgtttcaaaaccggaaagatatagtggcgacaacataatctacaaaccaccagggcattctgctccggatatggtgtacttgggagctatgacaaattttgatgtgacttacaattggattcaagataaatgtgttcctcttgtccgagaaataacatttgaaaatggagaggaattgacagaagaaggactgccttttctcatactctttcacatgaaagaagatacagaaagtttagaaatattccagaatgaagtagctcggcaattaataagtgaaaaaggtacaataaactttttacatgccgattgtgacaaatttagacatcctcttctgcacatacagaaaactccagcagattgtcctgtaatcgctattgacagctttaggcatatgtatgtgtttggagacttcaaagatgtattaattcctggaaaactcaagcaattcgtatttgacttacattctggaaaactgcacagagaattccatcatggacctgacccaactgatacagccccaggagagcaagcccaagatgtagcaagcagtccacctgagagctccttccagaaactagcacccagtgaatataggtatactctattgagggatcgagatgagctttaaaaacttgaaaaacagtttgtaagcctttcaacagcagcatcaacctacgtggtggaaatagtaaacctatattttcataattctatgtgtatttttattttgaataaacagaaagaaattttgggtttttaatttttttctccccgactcaaaatgcattgtcatttaatatagtagcctcttaaaaaaaaaaaacctgctaggatttaaaaataaaaatcagaggcctatctccactttaaatctgtcctgtaaaagttttataaatcaaatgaaaggtgacattgccagaaacttaccattaacttgcactactagggtagggaggacttagggatgtttcctgtgtcgtatgtgcttttctttctttcatatgatcaattctgttggtattttcagtatctcatttctcaaagctaaagagatatacattctggatacttgggaggggaataaattaaagttttcacactgtgtactgtgttttactgattggttggatattgcttatgaaaattccatagtggtatttttttggattcttaatgtgtaacttaaacatactttgaagtggaggagagtcataagacagaacatttggcaggaattgtccttatgaaacaagaaaaagaaaatgaaaagtattattaagcttctgtgtttgtctaaaaatgtggcatatggatggcatttaaaactttgaatgaattatacctaaatctgggacagggaggtgacagtggaacaggctaccaatcagaactagatgacttttaaggctcctcctattatgagacttcaatttccaaagagaagaactagcagagaaattgtatttcagtaattttaagctccttctgtcttgtagagtcttgttatagttgtataaatcaaaaacacagaataaggaacatatttaactttttttcattataaaatggttagaggaccctaccccctctagattccctgatttccccaggcctgcagcatacagtaagatgggtccctgtgccaggcctcaatactgccagggaataaaaccagagggagaggaccctcagtgtcatatcaggaagcccagtgccagaggacagacaggttcaaaactggcttttcctctgggcctgggttggtgctataggccaagggtcattttatacttgggtataaatcaatcccagtttgggaaaagattatttttaagcttaaaaggctgacatgtgccattatatgtagtatgtaatatatgtaacatcttccaattcttttaaaataaaattaatatttataatggatatttaatgattgttatttttaaaaaccagcttataattcctcgttatgcatgatttatccaaagtttccatagttttattcaaaataataaatgttaataaggtgataaggggtatatttaatgtattgtatcaaattgtgaataagaaagtaggatggagctttctagaggttgggccttagttctgttatcctcattgcttttaaccaataagttaaatgaagttagagttatggtcttcaggttagattatggaccagatctgtgagggtcagcatggaaattcacattcaacaaggtagcacacaggaccaagagcagcacatgcaatcaactggaataatatagtaatcctgtaactgggtttgaaaaaataatcaacaaaagatacaattcaagggttaggttgcagagagctggcttgagagtagttattatgaaaaaggcctcaaggagtacgtgttcagtatgctctaagatgataaagtggctgttaaaaagggagttgatttgaggaagtattacttagcattcatgcatattgggcttaggctctagccctgccactatcattgtcttctctggactgtgaagtcactgaggacaaggaaactaaatttaatgtctgtatcactagtgcctagaatttctggacacttagtagtcaccatcaggcgtttatttaatgaatgagaagcaaagtgaccttggttacttttttaccctgaggggctcagcactcattaggacttggtgcctaattttataaaaagtcactaagctcaagtgcttggatgaaaggacagcgtggataaaaaggtttttaaaacatggatgttaaggctgttttgcttggagaagacttgggactgggacagtctttagatattatttgaaatgctggcactgtctatctggatcccagggcttgaactaggatttgaggaagtcacagggaagcagatttcagtctgacatttattcagtgcaagttttttggtgctgtagtatatgatgaaagatgtaaagctgaataaagcattatttctgccctagagttgttcacagcctagtcaggcatatggatatgtaaacaatgactgtaacgtgttatagatgtaaagacaaaataaaggttaaagagggcataaaggagcactcaattgcagagatttgaggacattatttttattttgagctttaaaaagatgaataggtgttctcaggaggtagggatctggctgagagggaataatctgagcaaaggtatgaaacagcctaatgcattagagaaaaaagttcttttagtaaggcatttggggttggggaagctagaaaaagaaatgggagctggtcacacagggccttgtgtgccagactaaggggtttgtagtatatattgtaggcagaagagatccatcaacagattgcaagcaaggaagtatgttcactttaaagtttgagaaagaatagtgtggaagcacgtctcaaatttagacttgttccccctctgaaccgtgaatcagaccatttcaggtagaagtcttccccggtttatctgatctactcggggcctcaggcttctcagctgggaagagaggatgcaagaccagactgaagaacacggttgagtccccagaaccaaaagggggcctttctgcttcttagccagctacctcttcgagtttttcaaattgtgagggggaccataaaaggatggaaacttttagatgacattctacaaattatttttttctttaaattaaaagaacctagccaataagatagagaatgggcatctaaggcatctcagagctctctgatgaagccaggttgtcaaagatcatttgcaaaagaagggaaaactggcatgacaaaagctacagagaggagagtgaaatatagaagtgtttgaaatgttcaagctcacaataagcttaaatttatagaaaatgctaaggttgtcaagaaggcttttttttttttcttttttaaacctgagggcaaaaaggaatggataaagtagtgtaatggattgacaatcaggaagaacagaataactcagttttttttctcctacaaggagatatggctggaccaaaataaaatgacatgaaactgcaaaaatgaaaa

SEQ ID NO: 1219 - DNA, 2087 bp, Homo sapiens
aaagtgctgggattacaggcatgagccattgcgcatggcctatatacacactcttaaagagatgattcttacaaatccagttctaggatgatgagtaatgagcaaaaagctggaatgtttgagctcaaggacttggtttcaggagggggtacaaatattggaagagactcagtaaatgcagaaagtagaaaaagtaattagagagttaccagaagcttgctttttcttacagattcctcataagtcactgaataaatagttgtagcagatatccattctttttgcatggggccagagacccagaaaggctatcagagatttcagcttcctctgtatcaaggtgctttgggaagcaaagctgccctgtaggtgaaagcagtagaaatttggaagaaaactcattgttctagaactgtcatagaaatatctcagatatgaaagacttaaacaaaaaggatattgagggacggctttctgcaaagatgtggcctaagatatgtgcatatctgtactaggagttgctgttgtgcatcttgtttaactctcttagaagggacttcagcctatatgtggttgttattaattacattctcaggaacagaatattaattttctgttacagaaaacagtaaatcagaagaccacaatctacgaaattcaggatgatagaggaaaaatggatgtagtggggacaggacaatgtcacaatatcccctgtgaagaaggagataagctccaacttttctgctttcgacttagaaaaaagaaccagatgtcaaaactgatttcagaaatgcatagttttatccagataaagaaaaaaacaaacccgagaaacaatgaccccaagagcatgaagctaccccaggaacagagtcagcttccaaatccttcagaggccagcacaaccttccctgagagccatcttcggactcctcagatgccaccaacaactccatccagcagtttcttcaccaagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggtcatcaagaccaggaaaaacaagaaagacatactcaatcctgattcaagtatggaaacttcaccagactttttcttctaaaatctggatgtcattgacgataatgtttatggagataaggtctaagtgcctaaaaaaatgtacatatacctggttgaaatacaacactatacatacacaccaccatatatactagctgttaatcctatggaatggggtattgggagtgcttttttaatttttcatagtttttttttaataaaatggcatattttgcatctacaacttctataatttgaaaaaataaataaacattatcttttttgtg

SEQ ID NO: 1220 - DNA, 2070 bp, Homo sapiens
ctcatcaacatgcattcccagaaatgccatgaaaggaaagaccaagtcttgactgagaaacggaccgggcagatgagggactcccacatatacctgtttcctgctcttcccgaagacattttgccacaagcatataattcagcttctgaaaaatacggtcttcctcactgcagacaccatgccagcgttttaaatcaagttggctactcgtgctgtttagagtatgcagtttgcctgtggcaatattaaactcatctggaagaaagcacttaaacctatccagttcctcatcggtgatgttatccaggctggttagcaagagtatctccttatatttactctccatctcacgacttttcagcttataagggatccaaactatgtaagattataccaccaaaagtgattcaacattcaaaatgaagcaagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtggatgctacttcacctgcaccctccacaagcagcactgtcaaaactgaaggagcagaggcaactcctggagctcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacagttcttcaactgagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggtcatcaagaccaggaaaaacaagaaagacatactcaatcctgattcaagtatggaaacttcaccagactttttcttctaaaatctggatgtcattgacgataatgtttatggagataaggtctaagtgcctaaaaaaatgtacatatacctggttgaaatacaacactatacatacacaccaccatatatactagctgttaatcctatggaatggggtattgggagtgcttttttaatttttcatagtttttttttaataaaatggcatattttgcatctacaacttctataatttg

SEQ ID NO: 1221 - DNA, 4143 bp, Homo sapiens
gggcaatagcagaataggagcaagccagcactagtcagctaactaagtgactcaaccaaggccttttttccttgttatctttgcagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtggatgctacttcacctgcaccctccacaagcagcactgtcaaaactgaaggagcagaggcaactcctggagctcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacagttcttcaactgagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataagaaaacagtaaatcagaagaccacaatctacgaaattcaggatgatagaggaaaaatggatgtagtggggacaggacaatgtcacaatatcccctgtgaagaaggagataagctccaacttttctgctttcgacttagaaaaaagaaccagatgtcaaaactgatttcagaaatgcatagttttatccagataaagaaaaaaacaaacccgagaaacaatgaccccaagagcatgaagctaccccaggaacagagtcagcttccaaatccttcagaggccagcacaaccttccctgagagccatcttcggactcctcagatgccaccaacaactccatccagcagtttcttcaccaagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataaggtaagcccacaccattgttttataaaatttctcctgcaacctccaatttttaaagtcttaacttgtcaactggagtttggtcaacttactcaacacagaaaatcaaccccttcacccttcccccagcactagagataattgaatagagttcatttcaggatatggggtacgttatattgtaacattcctcttcttaaggtatcatcatgcaagttatttagacagtcactaggaaacttggcattttattagttttgatgatctattcagagccacccttgtccaggacagtgcagagtttatatcaacacacatatccttaggattttgtttctttgagttcttctccatctgtatcaatgacaacttaatttaattgtgaataaaagagttgctctcccaagcctgaatcctgattgtgacaaccagagtaagaaataaaatagactactctgctttagaatgcagctatgtctaacagttagctagaattctgatcatttggactccaaagtttcttgcctcttctcattcattaattcatcaggagactgtagagcaactaacttctgcattaaataataagagaaatacgaagcaaaaagactaaaaaagtcacgtagcttaactgctcaatttataaatggggcaataaaatgcaaaaaaaagaaaaaaagcttggtgaattcttaggcttacagtgtgcctttcagtctctacacatcatgtaaatattatgcttagctgatttaacttcttgtttgaagtactgtttcatactccattatacatgtcttctagggtggcttacttttaattgtgctgttttctctacactcagtttaaatgactgtacatatatatgtggttgtagagttaatgaataatgagctacaaaccagaacaatgtgactagatagataggatgatctagatttgagatctgggcagattgggaaagagtgactatatggagaagaaagaagtagttacatattgaaataacagtctacttaatgaggacgtgcaacattctttctcaaacttacaaagtgccataaaaagcctctattctctgctcttgggcaggtgtgaaagaaacctaccaaattaatcagatttttctgtatccaggctccttaaaaaatcccagctgtgctgatgtggaaacaggaagaattaggaaagtaatcaattttttttcctagaaaaaatccagcagacaaagaacttcaacaaaagaggctcaagggaggagttgaaaggcaggattcaaagaccaagtatcttaagctatttggtacctgttattcaggacctacagctctgtttactctatcaaagacaaaagtttccagaaacaccctgtatttctcatagatttgaaaattattgatccagtttcagaagataagtgttaattttcttttgcagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggtcatcaagaccaggaaaaacaagaaagacatactcaatcctgattcaagtatggaaacttcaccagactttttcttctaaaatctggatgtcattgacgataatgtttatggagataaggtctaagtgcctaaaaaaatgtacatatacctggttgaaatacaacactatacatacacaccaccatatatactagctgttaatcctatggaatggggtattgggagtgcttttttaatttttcatagtttttttttaataaaatggcatattttgcatctacaacttctataatttgaaaaaataaataaacattatcttttttgtgaaaggaa

SEQ ID NO: 1222 - DNA, 2877 bp, Homo sapiens
gggcaatagcagaataggagcaagccagcactagtcagctaactaagtgactcaaccaaggccttttttccttgttatctttgcagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtggatgctacttcacctgcaccctccacaagcagcactgtcaaaactgaaggagcagaggcaactcctggagctcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacagttcttcaactgagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataagaaaacagtaaatcagaagaccacaatctacgaaattcaggatgatagaggaaaaatggatgtagtggggacaggacaatgtcacaatatcccctgtgaagaaggagataagctccaacttttctgctttcgacttagaaaaaagaaccagatgtcaaaactgatttcagaaatgcatagttttatccagataaagaaaaaaacaaacccgagaaacaatgaccccaagagcatgaagctaccccaggaacagagtcagcttccaaatccttcagaggccagcacaaccttccctgagagccatcttcggactcctcagatgccaccaacaactccatccagcagtttcttcaccaagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggtcatcaagaccaggaaaaacaagaaagacatactcaatcctgattcaagtatggaaacttcaccagactttttcttctaaaatctggatgtcattgacgataatgtttatggagataaggtctaagtgcctaaaaaaatgtacatatacctggttgaaatacaacactatacatacacaccaccatatatactagctgttaatcctatggaatggggtattgggagtgcttttttaatttttcatagtttttttttaataaaatggcatattttgcatctacaacttctataatttgaaaaaataaataaacattatcttttttgtgaaaggaa

SEQ ID NO: 1223 - DNA, 2701 bp, Homo sapiens
gttgagagtccactatccacgtttgtttatccaggaataatgcagaaaatctgagcattcgtgaatctaatcattgagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtggatgctacttcacctgcaccctccacaagcagcactgtcaaaactgaaggagcagaggcaactcctggagctcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacagttcttcaactgagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataagaaaacagtaaatcagaagaccacaatctacgaaattcaggatgatagaggaaaaatggatgtagtggggacaggacaatgtcacaatatcccctgtgaagaaggagataagctccaacttttctgctttcgacttagaaaaaagaaccagatgtcaaaactgatttcagaaatgcatagttttatccagataaagaaaaaaacaaacccgagaaacaatgaccccaagagcatgaagctaccccaggaacagagtcagcttccaaatccttcagaggccagcacaaccttccctgagagccatcttcggactcctcagatgccaccaacaactccatccagcagtttcttcaccaagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggtcatcaagaccaggaaaaacaagaaagacatactcaatcctgattcaagtatggaaacttcaccagactttttcttctaaaatctggatgtcattgacgataatgtttatggagataaggtctaagtgcctaaaaaaatgtacatatacctggttgaaatacaacactatacatacacaccaccatatatactagctgttaatcctatggaatggggtattgggagtgcttttttaatttttcatagtttttttttaataaaatggcatattttgcatctacaacttctataatttgaaaaaataaataaacattatcttttttgtgaaaggaa

SEQ ID NO: 1224 - DNA, 2694 bp, Homo sapiens
aagactactcaggcgtgcactgcgaggtggagatctgacttctcttgttcccgcttaagactgcctcctgtatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtggatgctacttcacctgcaccctccacaagcagcactgtcaaaactgaaggagcagaggcaactcctggagctcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacagttcttcaactgagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataagaaaacagtaaatcagaagaccacaatctacgaaattcaggatgatagaggaaaaatggatgtagtggggacaggacaatgtcacaatatcccctgtgaagaaggagataagctccaacttttctgctttcgacttagaaaaaagaaccagatgtcaaaactgatttcagaaatgcatagttttatccagataaagaaaaaaacaaacccgagaaacaatgaccccaagagcatgaagctaccccaggaacagagtcagcttccaaatccttcagaggccagcacaaccttccctgagagccatcttcggactcctcagatgccaccaacaactccatccagcagtttcttcaccaagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggtcatcaagaccaggaaaaacaagaaagacatactcaatcctgattcaagtatggaaacttcaccagactttttcttctaaaatctggatgtcattgacgataatgtttatggagataaggtctaagtgcctaaaaaaatgtacatatacctggttgaaatacaacactatacatacacaccaccatatatactagctgttaatcctatggaatggggtattgggagtgcttttttaatttttcatagtttttttttaataaaatggcatattttgcatctacaacttctataatttgaaaaaataaataaacattatcttttttgtgaaaggaa

SEQ ID NO: 1225 - DNA, 3592 bp, Homo sapiens
gaggaagaggctgaggaggcgcggggggcgggggaggctcaggagcgggcggtgacggcgacggcggcggcagaggaggcagcggctgggccgggccccgtgcgtctgtccgcgccccgtggatgcgaatcggccgcggcggaggcggcggcggcggaggaggcggcggcgggaggaggagtcggtgagccggctccgggccggaggggcgcggaggatgaggccgctgcctggcgctcttggcgtggcggcggccgccgcgctgtggctgctgctgctgctgctgccccggacccgggcggacgagcacgaacacacgtatcaagataaagaggaagttgtcttatggatgaatactgttgggccctaccataatcgtcaagaaacatataagtacttttcacttccattctgtgtggggtcaaaaaaaagtatcagtcattaccatgaaactctgggagaagcacttcaaggggttgaattggaatttagtggtctggatattaaatttaaagatgatgtgatgccagccacttactgtgaaattgatttagataaagaaaagagagatgcatttgtatatgccataaaaaatcattactggtaccagatgtacatagatgatttaccaatatggggtattgttggtgaggctgatgaaaatggagaagattactatctttggacctataaaaaacttgaaataggttttaatggaaatcgaattgttgatgttaatctaactagtgaaggaaaggtgaaactggttccaaatactaaaatccagatttcatattcagtaaaatggaaaaagtcagatgtgaaatttgaagatcgatttgacaaatatcttgatccgtccttttttcaacatcggattcattggttttcaattttcaactccttcatgatggtgatcttcttggtgggcttagtttcaatgattttaatgagaacattaagaaaagattatgctcggtacagtaaagaggaagaaatggatgatatggatagagacctaggagatgaatatggatggaaacaggtgcatggagatgtatttagaccatcaagtcacccactgatattttcctctctgattggttctggatgtcagatatttgctgtgtctctcatcgttattattgttgcaatgatagaagatttatatactgagaggggatcaatgctcagtacagccatatttgtctatgctgctacgtctccagtgaatggttattttggaggaagtctgtatgctagacaaggaggaaggagatggataaagcagatgtttattggggcattccttatcccagctatggtgtgtggcactgccttcttcatcaatttcatagccatttattaccatgcttcaagagccattccttttggaacaatggtggccgtttgttgcatctgtttttttgttattcttcctctaaatcttgttggtacaatacttggccgaaatctgtcaggtcagcccaactttccttgtcgtgtcaatgctgtgcctcgtcctataccggagaaaaaatggttcatggagcctgcggttattgtttgcctgggtggaattttaccttttggttcaatctttattgaaatgtatttcatcttcacgtctttctgggcatataagatctattatgtctatggcttcatgatgctggtgctggttatcctgtgcattgtgactgtctgtgtgactattgtgtgcacatattttctactaaatgcagaagattaccggtggcaatggacaagttttctctctgctgcatcaactgcaatctatgtttacatgtattccttttactactattttttcaaaacaaagatgtatggcttatttcaaacatcattttactttggatatatggcggtatttagcacagccttggggataatgtgtggagcgattggttacatgggaacaagtgcctttgtccgaaaaatctatactaatgtgaaaattgactagagacccaagaaaacctggaactttggatcaatttctttttcataggggtggaacttgcacagcaaaaacaaacaaacgcaagaagagatttgggctttaacacactgggtactttgtgggtctctctttcgtcggtggcttaaagtaacatctatttccattgatcctaggttcttcctgactgctttctccaactgttcacagcaaatgcttggattttatgcagtaggcattactacagtacatggctaatcttcccaaaaactagctcattaaagatgaaatagaccagctctcttcagtgaagaggacaaatagtttatttaaagcatttgttccaataaaataaatagagggaaacttggatgctaaaattacatgaataggaatcttcctggcacttagtgtttctatgttattgaaaaatgatgttccagaaagattacttttttcctcttatttttactgccattgtcgacctattgtgggacatttttatatattgaatctgggttcttttttgacttttttttttcccaatccaacagcatccttttttttaaaagagagaattagaaaatattaaatcctgcatgtaatatatctgctgtcatcttagttggaccaacttcccatttatttatcttaaaactatacagttacatcttaattccatccaaagaagatacagtttgaagacagaagtgtactctctacaatgcaatttactgtacagttagaaagcaaagtgttaaatggagaagatacttgtttttattaaacattttgagatttagataaactacattttaactgaatgtctaaagtgattatcttttttccccccaagttagtcttaaatcttttgggtttgaatgaaggttttacataagaaattattaaaaacaaggggggtgggtaataaatgtatataacattaaataatgtaacgtaggtgtagattcccaaatgcatttggatgtacagatcgactacagagtacttttttcttatgatgattggtgtagaaatgtgtgatttgggtgggcttttacatcttgcctaccattgcatgaaacattggggtttcttcaaaatgtgtgtgtcatacttcttttgggaggggggttgttttcttctgtttattttctgagactcctacaggagccaaatttgtaatttagagacacttaattttgttaatcctgtctgggacacttaagtaacatctaaagcattattgctttagaatgttcaaataaaatttcctgaccaaattgttttgtggaaatagatgtgtttgcaatttgaagatatctttctgtccagaaggcaaaattaccgaatgccatttttaaaagtatgctataaactatgctactctcatacaggggacccgtattttaaaatctccagacttgcttacatctagattatccagcacaatcataaagtgaatgacaaaccctttgaatgaaattgtggcacaaaatctgttcaggttggtgtaccgtgtaaagtggggatggggtaaaagtggttaacgtactgttggatcaacaaataaaggttacagttttgtaagagaaaaaaaaaaaaaaaaaa

SEQ ID NO: 1226 - DNA, 8206 bp, Homo sapiens; identical to SEQ ID NO: 738

SEQ ID NO: 1227 - DNA, 9448 bp, Homo sapiens; identical to SEQ ID NO: 740

SEQ ID NO: 1228 - DNA, 1008 bp, Homo sapiens
gggaggagctggtctcgcgaggccgcgccccggttcgcgcgggcgtcgtgcacgcggttgtagctgcccggcggcggcagaagcggcgctcgcgccaagggacgtgtttctgcgctcgcgtggtcatggaggcgctgccgctgctagccgcgacaactccggaccacggccgccaccgaaggctgcttctgctgccgctactgctgttcctgctgccggctggagctgtgcagggctgggagacagaggagaggccccggactcgcgaagaggagtgccacttctacgcgggtggacaagtgtacccgggagaggcatcccgggtatcggtcgccgaccactccctgcacctaagcaaagcgaagatttccaagccagcgccctactgggaaggaacagctgtgatcgatggagaatttaaggagctgaagttaactgattatcgtgggaaatacttggttttcttcttctacccacttgatttcacatttgtgtgtccaactgaaattatcgcttttggcgacagacttgaagaattcagatctataaatactgaagtggtagcatgctctgttgattcacagtttacccatttggcctggattaatacccctcgaagacaaggaggacttgggccaataaggattccacttctttcagatttgacccatcagatctcaaaggactatggtgtatacctagaggactcaggccacactcttagaggtctcttcattattgatgacaaaggaatcctaagacaaattactctgaatgatcttcctgtgggtagatcagtggatgagacactacgtttggttcaagcattccagtacactgacaaacacggagaagtctgccctgctggctggaaacctggtagtgaaacaataatcccagatccagctggaaagctgaagtatttcgataaactgaattgagaaatacttcttcaagttatgatgcttgaaagttctcaataaagttcacggtttcattaccacattg

SEQ ID NO: 1229 - DNA, 911 bp, Homo sapiens
gtcatggaggcgctgccgctgctagccgcgacaactccggaccacggccgccaccgaaggctgcttctgctgccgctactgctgttcctgctgccggctggagctgtgcagggctgggagacagaggagaggccccggactcgcgaagaggagtgccacttctacgcgggtggacaagtgtacccgggagaggcatcccgggtatcggtcgccgaccactccctgcacctaagcaaagcgaagatttccaagccagcgccctactgggaaggaacagctgtgatcgatggagaatttaaggagctgaagttaactgattatcgtgggaaatacttggttttcttcttctacccacttgatttcacatttgtgtgtccaactgaaattatcgcttttggcgacagacttgaagaattcagatctataaatactgaagtggtagcatgctctgttgattcacagtttacccatttggcctggattaatacccctcgaagacaaggaggacttgggccaataaggattccacttctttcagatttgacccatcagatctcaaaggactatggtgtatacctagaggactcaggccacactcttagaggtctcttcattattgatgacaaaggaatcctaagacaaattactctgaatgatcttcctgtgggtagatcagtggatgagacactacgtttggttcaagcattccagtacactgacaaacacggagaagtctgccctgctggctggaaacctggtagtgaaacaataatcccagatccagctggaaagctgaagtatttcgataaactgaattgagaaatacttcttcaagttatgatgcttgaaagttctcaataaagttcacggtttcattaccaaaaaaaaaaaaaaaaaaaaaaaaaaaaaaa

SEQ ID NO: 1230 - DNA, 6938 bp, Homo sapiens
ctttgccttcaagtacaggccggggtccggaagcggtgataccccttctctttcccagtggccctcaaacttccttttcccgggtccttaagcgggccccgccgacagaggccaatcagagggcagcgcgagggggcggggccatagtttaaactaattgtgcgctcacagcgctggcgcgagcccacgaagaggtacgattccggagaatcgcgaggcagagcgggagcgcgcagccaggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggtagaggcactggcaggatgggggagggaaacccgatgagagcatgggcaccccccagaccgccccaccaagtagcatccaagatggggccacgccaggctgctggagggtgtggggtaagaggtgtccctgtcctggtagctcctctccaaggagagaagacagatggccccattctcatggagagcacccagagctgctcaggcacagccagcaactgataaccctggggctcacaagggaggggatccagacaggggcgtgggagcaggaagagatcttcccagccagtgggtgcaggc

SEQ ID NO: 1231 - DNA, 6992 bp, Homo sapiens
ctttgccttcaagtacaggccggggtccggaagcggtgataccccttctctttcccagtggccctcaaacttccttttcccgggtccttaagcgggccccgccgacagaggccaatcagagggcagcgcgagggggcggggccatagtttaaactaattgtgcgctcacagcgctggcgcgagcccacgaagaggtacgattccggagaatcgcgaggcagagcgggagcgcgcagccaggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccagacataaagcactcatgacaattatacctgatttgtcccccaacaaccctctgagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggtagaggcactggcaggatgggggagggaaacccgatgagagcatgggcaccccccagaccgccccaccaagtagcatccaagatggggccacgccaggctgctggagggtgtggggtaagaggtgtccctgtcctggtagctcctctccaaggagagaagacagatggccccattctcatggagagcacccagagctgctcaggcacagccagcaactgataaccctggggctcacaagggaggggatccagacaggggcgtgggagcaggaagagatcttcccagccagtgggtgcaggc

SEQ ID NO: 1232 - DNA, 4844 bp, Homo sapiens
catggcttcccttctgcttgctgtctgatccacagaacgctggggttgcccaggataatgtgaggctgagctcactaagagtgggtgggttaggggaatgaataatcattcctgtccctttgccccttccctaggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccag

SEQ ID NO: 1233 - DNA, 4894 bp, Homo sapiens
gtcccctgcttgctgtcgctcccagatcggggaagcttgctgtgcctttaaagaaagcagactcctggctgtgacgcacttctggctgtcagccaggaagatcgctcctgccaggcagactgagaagaaaaccaacaacttttcttttgtgtgtggggttactttccactggcccccccttcctcctctcctttcaagatttaaatgctaatggcggattaaaacctgtagatacgtttggctttaggagtctggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccag

SEQ ID NO: 1234 - DNA, 2148 bp, Homo sapiens
ctttgccttcaagtacaggccggggtccggaagcggtgataccccttctctttcccagtggccctcaaacttccttttcccgggtccttaagcgggccccgccgacagaggccaatcagagggcagcgcgagggggcggggccatagtttaaactaattgtgcgctcacagcgctggcgcgagcccacgaagaggtacgattccggagaatcgcgaggcagagcgggagcgcgcagccaggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaaggtaaccctctgctggggtcacagccacagtcttgaccacatgtgcaaagctgagtccagtttaccactgtgctcttctgggcctttgggtattaagttgctttctcttcaaggttcaatagtgtgctgtaattgaaagattgtgggcttcagtctagtacaccttttttttttaacttatttttttttttccccagtcaatgccctcactttatagtacacctttcaatcctatctctgctgttcacaagatgtggatcttggacaagttaatcagtctgtttttctaagcatcctttccctaaaatgggagtagtaacgagtagctgcctcatcacctattatgagaaaacgtatgtaaagcacttcacacatcgtgtagtgtaaagtaagctctcagtgaaccagttgtgattgttactattggtaagaacccaatttggccacttactaataaccatgtagcccttgatcaaggcacttagcatctgcttcaggttcttgctctgtaagaggaatggtagtagctgcctcccacataagctgggtgtggtgatgcatgcctgtagtcccagctactcgggaggctgagacagaagaagctctcgaatctgggaggtggaggttgcagtaagccaagatctcgccactgcactccagcctaggcgatagagcgagactctgtctc

SEQ ID NO: 1235 - DNA, 3572 bp, Homo sapiens
ctttgccttcaagtacaggccggggtccggaagcggtgataccccttctctttcccagtggccctcaaacttccttttcccgggtccttaagcgggccccgccgacagaggccaatcagagggcagcgcgagggggcggggccatagtttaaactaattgtgcgctcacagcgctggcgcgagcccacgaagaggtacgattccggagaatcgcgaggcagagcgggagcgcgcagccaggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggtagaggcactggcaggatgggggagggaaacccgatgagagcatgggcaccccccagaccgccccaccaagtagcatccaagatggggccacgccaggctgctggagggtgtggggtaagaggtgtccctgtcctggtagctcctctccaaggagagaagacagatggccccattctcatggagagcacccagagctgctcaggcacagccagcaactgataaccctggggctcacaagggaggggatccagacaggggcgtgggagcaggaagagatcttcccagccagtgggtgcaggc

SEQ ID NO: 1236 - DNA, 8440 bp, Homo sapiens
ctttgccttcaagtacaggccggggtccggaagcggtgataccccttctctttcccagtggccctcaaacttccttttcccgggtccttaagcgggccccgccgacagaggccaatcagagggcagcgcgagggggcggggccatagtttaaactaattgtgcgctcacagcgctggcgcgagcccacgaagaggtacgattccggagaatcgcgaggcagagcgggagcgcgcagccaggtggaaactaattctaagccagactgctggagatcaccctgttctagtgtgtggaggcttccaccaggagtctggagtgcaatggcacgatctcggctcactgcaacctccacctcccaggttcaagcgattctcctgcctcagcctcccaagtagctgggattacaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggcaaagcactaaagggccagtaccagtgagtggccccacctgtgtccccgatgctgccgtcacctggtcctccgcctactgtccctctcagtgccttctctcagctcccaggccaacagtagccaaacccctagagacagtgatgcctgcccgcaccctggcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctgtgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtgagtactgagttgacttgatcggtgtgggaaaaagaggaatataggctctttgaagcctaccttgttcctgctgagtcttccataccacctcctttctctcatcccttttcctgaggccacatctttccaggctcttcccactctccattagtggcctctgctcccggggagcattatgggctgttctctcttttctttttcaagcgcctgtgttcccctgaagcaggtgttgtcttcagcttctgtgtggcagtccctctctcccatactccctcgtgggacaggcaaagttcctgggagtggaactgaagcctaaatgaacagatgtcaggatgcctccattgaataatcctttatgaggacccatgtggggatgacacagatacagtgtggatccgaagcagctgctgcccccatcccttccctggaacagtccattagagtgaagggggaaaaaaaaaaacatacagcacgaagataggaagtctgcagaatgcggccagagctgaaagaggatgacttcactgaagaggcagcatttcaaccaggcttgagcgttcccctgctggggcggtgaggaagacgggactaaatgagcagagacatgggagtgggagctgtctgggaaaagcaagaatagttgggaggcttccagaaagtcatgtgggaaatgcaggtagggccctggagtgcaaggctaaggcatcaacagtcttggtggtttctgagcagtagagcagtgtgaggagtaggacgttaggaaggctaatggataggtggagagagaatggcaggaggaggaggcattataaggaggctgtgattttctaggtaggtgggaatggagtttgaatttggtgagagaagggacccaaagcagagaaggagggggtgtgttgcgcatccacgcagcctacaggcagtcagggactgttcactccaggtagacaggtaggacccaagctctggtcaaggttgtgctgctgctggccctgtgctgagtcttaaccctgctgctgtggactgctgtgg

SEQ ID NO: 1237 - DNA, 8342 bp, Homo sapiens
ctttgccttcaagtacaggccggggtccggaagcggtgataccccttctctttcccagtggccctcaaacttccttttcccgggtccttaagcgggccccgccgacagaggccaatcagagggcagcgcgagggggcggggccatagtttaaactaattgtgcgctcacagcgctggcgcgagcccacgaagaggtacgattccggagaatcgcgaggcagagcgggagcgcgcagccaggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggcaaagcactaaagggccagtaccagtgagtggccccacctgtgtccccgatgctgccgtcacctggtcctccgcctactgtccctctcagtgccttctctcagctcccaggccaacagtagccaaacccctagagacagtgatgcctgcccgcaccctggcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctgtgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtgagtactgagttgacttgatcggtgtgggaaaaagaggaatataggctctttgaagcctaccttgttcctgctgagtcttccataccacctcctttctctcatcccttttcctgaggccacatctttccaggctcttcccactctccattagtggcctctgctcccggggagcattatgggctgttctctcttttctttttcaagcgcctgtgttcccctgaagcaggtgttgtcttcagcttctgtgtggcagtccctctctcccatactccctcgtgggacaggcaaagttcctgggagtggaactgaagcctaaatgaacagatgtcaggatgcctccattgaataatcctttatgaggacccatgtggggatgacacagatacagtgtggatccgaagcagctgctgcccccatcccttccctggaacagtccattagagtgaagggggaaaaaaaaaaacatacagcacgaagataggaagtctgcagaatgcggccagagctgaaagaggatgacttcactgaagaggcagcatttcaaccaggcttgagcgttcccctgctggggcggtgaggaagacgggactaaatgagcagagacatgggagtgggagctgtctgggaaaagcaagaatagttgggaggcttccagaaagtcatgtgggaaatgcaggtagggccctggagtgcaaggctaaggcatcaacagtcttggtggtttctgagcagtagagcagtgtgaggagtaggacgttaggaaggctaatggataggtggagagagaatggcaggaggaggaggcattataaggaggctgtgattttctaggtaggtgggaatggagtttgaatttggtgagagaagggacccaaagcagagaaggagggggtgtgttgcgcatccacgcagcctacaggcagtcagggactgttcactccaggtagacaggtaggacccaagctctggtcaaggttgtgctgctgctggccctgtgctgagtcttaaccctgctgctgtggactgctgtgg

SEQ ID NO: 1238 - DNA, 6980 bp, Homo sapiens
ctttgccttcaagtacaggccggggtccggaagcggtgataccccttctctttcccagtggccctcaaacttccttttcccgggtccttaagcgggccccgccgacagaggccaatcagagggcagcgcgagggggcggggccatagtttaaactaattgtgcgctcacagcgctggcgcgagcccacgaagaggtacgattccggagaatcgcgaggcagagcgggagcgcgcagccaggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggagcagctagaggtatttcagagagagcaaactaagcaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggtagaggcactggcaggatgggggagggaaacccgatgagagcatgggcaccccccagaccgccccaccaagtagcatccaagatggggccacgccaggctgctggagggtgtggggtaagaggtgtccctgtcctggtagctcctctccaaggagagaagacagatggccccattctcatggagagcacccagagctgctcaggcacagccagcaactgataaccctggggctcacaagggaggggatccagacaggggcgtgggagcaggaagagatcttcccagccagtgggtgcaggc

SEQ ID NO: 1239 - DNA, 1391 bp, Homo sapiens
ctgcgggttctgcaaagtcaggctagctggctctccgcctgctccgcaccccggcgaggttccggtggggaggggtagggatggttcagccccgccccgctagggcggggcctgcgcctgcgcgctcagcggccgggcgtgtaacccacgggtgcgcgcccacgaccgccagactcgagcagtctctggaacacgctgcggggctcccgggcctgagccaggtctgttctccacgcaggtgttccgcgcgccccgttcagccatgtcgtccggcatccatgtagcgctggtgactggaggcaacaagggcatcggcttggccatcgtgcgcgacctgtgccggctgttctcgggggacgtggtgctcacggcgcgggacgtgacgcggggccaggcggccgtacagcagctgcaggcggagggcctgagcccgcgcttccaccagctggacatcgacgatctgcagagcatccgcgccctgcgcgacttcctgcgcaaggagtacgggggcctggacgtgctggtcaacaacgcgggcatcgccttcaaggttgctgatcccacaccctttcatattcaagctgaagtgacgatgaaaacaaatttctttggtacccgagatgtgtgcacagaattactccctctaataaaaccccaagggagagtggtgaacgtatctagcatcatgagcgtcagagcccttaaaagctgcagcccagagctgcagcagaagttccgcagtgagaccatcactgaggaggagctggtggggctcatgaacaagtttgtggaggatacaaagaagggagtgcaccagaaggagggctggcccagcagcgcatacggggtgacgaagattggcgtcaccgttctgtccaggatccacgccaggaaactgagtgagcagaggaaaggggacaagatcctcctgaatgcctgctgcccagggtgggtgagaactgacatggcgggacccaaggccaccaagagcccagaagaaggtgcagagacccctgtgtacttggcccttttgcccccagatgctgagggtccccatggacaatttgtttcagagaagagagttgaacagtggtgagctgggctcacagctccatccatgggccccattttgtaccttgtcctgagttggtccaaagggcatttacaatgtcataaatatccttatataagaaaaaaaatgatctcttatcaattagcactcactaatgtactactaattgagcaacctacgcactcagttgactacgtaaatctgtcaggtcttttgtgatttcctctgatgcaggagaggaaaaattgtaattgatgaaaataatgaatgaaaatcaacagatgaataaatggttctttataagtgtccatttgtacag

SEQ ID NO: 1240 - DNA, 1021 bp, Homo sapiens
ctggaacacgctgcggggctcccgggcctgagccaggtctgttctccacgcaggtgttccgcgcgccccgttcagccatgtcgtccggcatccatgtagcgctggtgactggaggcaacaagggcatcggcttggccatcgtgcgcgacctgtgccggctgttctcgggggacgtggtgctcacggcgcgggacgtgacgcggggccaggcggccgtacagcagctgcaggcggagggcctgagcccgcgcttccaccagctggacatcgacgatctgcagagcatccgcgccctgcgcgacttcctgcgcaaggagtacgggggcctggacgtgctggtcaacaacgcgggcatcgccttcaaggttgctgatcccacaccctttcatattcaagctgaagtgacgatgaaaacaaatttctttggtacccgagatgtgtgcacagaattactccctctaataaaaccccaagggagagtggtgaacgtatctagcatcatgagcgtcagagcccttaaaagctgcagcccagagctgcagcagaagttccgcagtgagaccatcactgaggaggagctggtggggctcatgaacaagtttgtggaggatacaaagaagggagtgcaccagaaggagggctggcccagcagcgcatacggggtgacgaagattggcgtcaccgttctgtccaggatccacgccaggaaactgagtgagcagaggaaaggggacaagatcctcctgaatgcctgctgcccagggtgggtgagaactgacatggcgggacccaaggccaccaagagcccagaagaaggtgcagagacccctgtgtacttggcccttttgcccccagatgctgagggtccccatggacaatttgtttcagagaagagagttgaacagtggtgagctgggctcacagctccatccatgggccccattttgtaccttgtcctgagttggtccaaagggcatttacaatgtcataaatatccttatataaaaaaaaaaaaaaaaaa

SEQ ID NO: 1241 - DNA, 1506 bp, Homo sapiens
attgcagtacatttgagaaagtaaaggtgtagtggaaaccgagagcgaaatgagggcgtagggagaaaagggtggggaagcttagagaccggtgagggagcagagctggggcgcctgtgtacagggatagagcccggcggcagcagggcgcggcttccctttcccggggcctggggccgcaatcaggtggagtcgagaggccggaggaggggcaggaggaaggggtgcggtcgcgatccggacccggagccagcgcggagcacctgcgcccgcggctgacaccttcgctcgcagtttgttcgcagtttactcgcacaccagtttcccccaccgcgctttggattagtgtgatctcagctcaaggcaaaggtgggatatcatggcatctatctgggttggacaccgaggaacagtaagagattatccagactttagcccatcagtggatgctgaagctattcagaaagcaatcagaggaattggaactgatgagaaaatgctcatcagcattctgactgagaggtcaaatgcacagcggcagctgattgttaaggaatatcaagcagcatatggaaaggagctgaaagatgacttgaagggtgatctctctggccactttgagcatctcatggtggccctagtgactccaccagcagtctttgatgcaaagcagctaaagaaatccatgaagggcgcgggaacaaacgaagatgccttgattgaaatcttaactaccaggacaagcaggcaaatgaaggatatctctcaagcctattatacagtatacaagaagagtcttggagatgacattagttccgaaacatctggtgacttccggaaagctctgttgactttggcagatgtaagaagagatgaaagtctgaaagtggatgagcatctggccaaacaagatgcccagattctctataaagctggtgagaacagatggggcacggatgaagacaaattcactgagatcctgtgtttaaggagctttcctcaattaaaactaacatttgatgaatacagaaatatcagccaaaaggacattgtggacagcataaaaggagaattatctgggcattttgaagacttactgttggccatagttaattgtgtgaggaacacgccggcctttttagccgaaagactgcatcgagccttgaagggtattggaactgatgagtttactctgaaccgaataatggtgtccagatcagaaattgaccttttggacattcgaacagagttcaagaagcattatggctattccctatattcagcaattaaatcggatacttctggagactatgaaatcacactcttaaaaatgggctttcccaacagctccaccttacttcttctcatactatttaagagaacaagcaaatataaacagcaacttgtgttcctaacaggaattttcattgttctataacaacaacaacaaaagcgattattattttagagcatctcatttataatgtagcagctcataaatgaaat

SEQ ID NO: 1242 - DNA, 1688 bp, Homo sapiens
attgcagtacatttgagaaagtaaaggtgtagtggaaaccgagagcgaaatgagggcgtagggagaaaagggtggggaagcttagagaccggtgagggagcagagctggggcgcctgtgtacagggatagagcccggcggcagcagggcgcggcttccctttcccggggcctggggccgcaatcaggtggagtcgagaggccggaggaggggcaggaggaaggggtgcggtcgcgatccggacccggagccagcgcggagcacctgcgcccgcggctgacaccttcgctcgcagtttgttcgcagtttactcgcacaccagtttcccccaccgcgctttggattagtgtgatctcagctcaaggcaaaggtgggatatcatggcatctatctgggttggacaccgaggaacagtaagagattatccagactttagcccatcagtggatgctgaagctattcagaaagcaatcagaggaattggaactgatgagaaaatgctcatcagcattctgactgagaggtcaaatgcacagcggcagctgattgttaaggaatatcaagcagcatatggaaaggagctgaaagatgacttgaagggtgatctctctggccactttgagcatctcatggtggccctagtgactccaccagcagtctttgatgcaaagcagctaaagaaatccatgaagggcgcgggaacaaacgaagatgccttgattgaaatcttaactaccaggacaagcaggcaaatgaaggatatctctcaagcctattatacagtatacaagaagagtcttggagatgacattagttccgaaacatctggtgacttccggaaagctctgttgactttggcagatggcagaagagatgaaagtctgaaagtggatgagcatctggccaaacaagatgcccagattctctataaagctggtgagaacagatggggcacggatgaagacaaattcactgagatcctgtgtttaaggagctttcctcaattaaaactaacatttgatgaatacagaaatatcagccaaaaggacattgtggacagcataaaaggagaattatctgggcattttgaagacttactgttggccatagttaattgtgtgaggaacacgccggcctttttagccgaaagactgcatcgagccttgaagggtattggaactgatgagtttactctgaaccgaataatggtgtccagatcagaaattgaccttttggacattcgaacagagttcaagaagcattatggctattccctatattcagcaattaaatcggatacttctggagactatgaaatcacactcttaaaaatctgtggtggagatgactgaaccaagaagataatctccaaaggtccacgatgggctttcccaacagctccaccttacttcttctcatactatttaagagaacaagcaaatataaacagcaacttgtgttcctaacaggaattttcattgttctataacaacaacaacaaaagcgattattattttagagcatctcatttataatgtagcagctcataaatgaaattgaaaatggtattaaagatctgcaactactatccaacttatatttctgctttcaaagttaagaatctttatagttctaatccattaaatataaagcaagataataaaaattgttgcttttgttaaaagtaat

SEQ ID NO: 1243 - DNA, 1268 bp, Homo sapiens
tagtgtgatctcagctcaaggcaaaggtgggatatcatggcatctatctgggttggacaccgaggaacagtaagagattatccagactttagcccatcagtggatgctgaagctattcagaaagcaatcagaggaattggaactgatgagaaaatgctcatcagcattctgactgagaggtcaaatgcacagcggcagctgattgttaaggaatatcaagcagcatatggaaaggagctgaaagatgacttgaagggtgatctctctggccactttgagcatctcatggtggccctagtgactccaccagcagtctttgatgcaaagcagctaaagaaatccatgaagggcgcgggaacaaacgaagatgccttgattgaaatcttaactaccaggacaagcaggcaaatgaaggatatctctcaagcctattatacagtatacaagaagagtcttggagatgacattagttccgaaacatctggtgacttccggaaagctctgttgactttggcagatggcagaagagatgaaagtctgaaagtggatgagcatctggccaaacaagatgcccagattctctataaagctggtgagaacagatggggcacggatgaagacaaattcactgagatcctgtgtttaaggagctttcctcaattaaaactaacatttgatgaatacagaaatatcagccaaaaggacattgtggacagcataaaaggagaattatctgggcattttgaagacttactgttggccatagttaattgtgtgaggaacacgccggcctttttagccgaaagactgcatcgagccttgaagggtattggaactgatgagtttactctgaaccgaataatggtgtccagatcagaaattgaccttttggacattcgaacagagttcaagaagcattatggctattccctatattcagcaattaaatcggatacttctggagactatgaaatcacactcttaaaaatctgtggtggagatgactgaaccaagaagataatctccaaaggtccacgatgggcttttccaacagctccaccttacttcttctcatactatttaagagaacaagcaaatataaacagcaacttgtgttcctaacaggaattttcattgttctataacaacaacaacaaaagcgattattattttagagcatctcatttataatgtagcagctcataaatgaaattgaaaatggtattaaagatctgcaactactatccaacttatatttctgctttcaa

SEQ ID NO: 1244 - DNA, 1691 bp, Homo sapiens
attgcagtacatttgagaaagtaaaggtgtagtggaaaccgagagcgaaatgagggcgtagggagaaaagggtggggaagcttagagaccggtgagggagcagagctggggcgcctgtgtacagggatagagcccggcggcagcagggcgcggcttccctttcccggggcctggggccgcaatcaggtggagtcgagaggccggaggaggggcaggaggaaggggtgcggtcgcgatccggacccggagccagcgcggagcacctgcgcccgcggctgacaccttcgctcgcagtttgttcgcagtttactcgcacaccagtttcccccaccgcgctttggattagtgtgatctcagctcaaggcaaaggtgggatatcatggctatttccttctaggttggacaccgaggaacagtaagagattatccagactttagcccatcagtggatgctgaagctattcagaaagcaatcagaggaattggaactgatgagaaaatgctcatcagcattctgactgagaggtcaaatgcacagcggcagctgattgttaaggaatatcaagcagcatatggaaaggagctgaaagatgacttgaagggtgatctctctggccactttgagcatctcatggtggccctagtgactccaccagcagtctttgatgcaaagcagctaaagaaatccatgaagggcgcgggaacaaacgaagatgccttgattgaaatcttaactaccaggacaagcaggcaaatgaaggatatctctcaagcctattatacagtatacaagaagagtcttggagatgacattagttccgaaacatctggtgacttccggaaagctctgttgactttggcagatgtaagaagagatgaaagtctgaaagtggatgagcatctggccaaacaagatgcccagattctctataaagctggtgagaacagatggggcacggatgaagacaaattcactgagatcctgtgtttaaggagctttcctcaattaaaactaacatttgatgaatacagaaatatcagccaaaaggacattgtggacagcataaaaggagaattatctgggcattttgaagacttactgttggccatagttaattgtgtgaggaacacgccggcctttttagccgaaagactgcatcgagccttgaagggtattggaactgatgagtttactctgaaccgaataatggtgtccagatcagaaattgaccttttggacattcgaacagagttcaagaagcattatggctattccctatattcagcaattaaatcggatacttctggagactatgaaatcacactcttaaaaatctgtggtggagatgactgaaccaagaagataatctccaaaggtccacgatgggctttcccaacagctccaccttacttcttctcatactatttaagagaacaagcaaatataaacagcaacttgtgttcctaacaggaattttcattgttctataacaacaacaacaaaagcgattattattttagagcatctcatttataatgtagcagctcataaatgaaattgaaaatggtattaaagatctgcaactactatccaacttatatttctgctttcaaagttaagaatctttatagttctaatccattaaatataaagcaagataataaaaattgttgcttttgttaaaagtaat

SEQ ID NO: 1245 - DNA, 1347 bp, Homo sapiens
attagtgtgatctcagctcaaggcaaaggtgggatatcatggcatctatctgggttggacaccgaggaacagtaagagattatccagactttagcccatcagtggatgctgaagctattcagaaagcaatcagaggaattggaactgatgagaaaatgctcatcagcattctgactgagaggtcaaatgcacagcggcagctgattgttaaggaatatcaagcagcatatggaaaggagctgaaagatgacttgaagggtgatctctctggccactttgagcatctcatggtggccctagtgactccaccagcagtctttgatgcaaagcagctaaagaaatccatgaagggcgcgggaacaaacgaagatgccttgattgaaatcttaactaccaggacaagcaggcaaatgaaggatatctctcaagcctattatacagtatacaagaagagtcttggagatgacattagttccgaaacatctggtgacttccggaaagctctgttgactttggcagatggcagaagagatgaaagtctgaaagtggatgagcatctggccaaacaagatgcccagattctctataaagctggtgagaacagatggggcacggatgaagacaaattcactgagatcctgtgtttaaggagctttcctcaattaaaactaacatttgatgaatacagaaatatcagccaaaaggacattgtggacagcataaaaggagaattatctgggcattttgaagacttactgttggccatagttaattgtgtgaggaacacgccggcctttttagccgaaagactgcatcgagccttgaagggtattggaactgatgagtttactctgaaccgaataatggtgtccagatcagaaattgaccttttggacattcgaacagagttcaagaagcattatggctattccctatattcagcaattaaatcggatacttctggagactatgaaatcacactcttaaaaatctgtggtggagatgactgaaccaagaagataatctccaaaggtccacgatgggctttcccaacagctccaccttacttcttctcatactatttaagagaacaagcaaatataaacagcaacttgtgttcctaacaggaattttcattgttctataacaacaacaacaaaagcgattattattttagagcatctcatttataatgtagcagctcataaatgaaattgaaaatggtattaaagatctgcaactactatccaacttatatttctgctttcaaagttaagaatctttatagttctaatccattaaatataaagcaagataataaaaattgttgcttttgttaaaagtaat

SEQ ID NO: 1246 - DNA, 3505 bp, Homo sapiens
ggatccggaagcacaggagaccaagagaccagagataccaggatgagagataggacccctggttgccaggttcgagaagtcctaggctgagtccctggaaatggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctgagaagagcgttcctctttgcatcctctatgagaaataccgtgactgccttacggagtccaacctcatcaaggtgcgggccctcctcgtggagccagttatcaacagctacctgctggctgagagggacctctacctggagaatccagaaatcaagatccggatccttggggagcccaagcagaaacgcaagctggtggctgaggtgtccctgcagaacccgctccctgtggccctggaaggctgcaccttcactgtggagggggccggcctgactgaggagcagaagacggtggagatcccagaccccgtggaggcaggggaggaagttaaggtgagaatggacctgctgccgctccacatgggcctccacaagctggtggtgaacttcgagagcgacaagctgaaggctgtgaagggcttccggaatgtcatcattggccccgcctaagggacccctgctcccagcctgctgagagcccccaccttgatcccaatccttatcccaagctagtgagcaaaatatgccccttcttgggccccagaccccagggcagggtgggcagcctatgggggctctcggaaatggaatgtgcccctggcccatctcagcctcctgagcctgtgggtccccactcaccccctttgctgtgaggaatgctctgtgccagaaacagtgggagccctgaccttggctgactggggctggggtgagagaggaaagacctacattccctctcctgcccagatgccctttggaaagccattgaccacccaccatattgtttgatctacttcatagctccttggagcaggcaaaaaagggacagcatgccccttggctggatcagggaatccagctccctagactgcatcccgtacctcttcccatgactgcacccagctccaggggcccttgggacagccagagctgggtggggacagtgataggcccaaggggggcctccaacccatttaatcaccatgggaaactgttgtgggcgctgcttccaggataaggagactgaggcttagagagaggaggcagccccctccacaccagtccactccctgctccacgaagccttaagccataggcccaggatatttctgagagtgaaaccatgactgtgaccaccttctgtccccagccctgtcctggttccttcctatgcccaggtaccacccttcagaccccagttctaggggagaagagccctggacacccctgctctacccatgagcctgcccgctgcaatgcctagacttcccaacagccttagctgccagtgctggtcactaaccaacaaggttggcaccccagctaccccttctttgcagggctaaggcccccaaacatagcccctgccccggaggaagcttggggaacccatgagttgtcagctttgactttatctcctgctctttctacatgactgggcctcccttgggctggaagaattggggattctctattggaggtgagatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaa

SEQ ID NO: 1247 - DNA, 3937 bp, Homo sapiens
ataagttagcgccgctctccgcctcggcagtgccagccgccagtggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctgagaagagcgttcctctttgcatcctctatgagaaataccgtgactgccttacggagtccaacctcatcaaggtgcgggccctcctcgtggagccagttatcaacagctacctgctggctgagagggacctctacctggagaatccagaaatcaagatccggatccttggggagcccaagcagaaacgcaagctggtggctgaggtgtccctgcagaacccgctccctgtggccctggaaggctgcaccttcactgtggagggggccggcctgactgaggagcagaagacggtggagatcccagaccccgtggaggcaggggaggaagttaaggtgagaatggacctgctgccgctccacatgggcctccacaagctggtggtgaacttcgagagcgacaagctgaaggctgtgaagggcttccggaatgtcatcattggccccgcctaagggacccctgctcccagcctgctgagagcccccaccttgatcccaatccttatcccaagctagtgagcaaaatatgccccttcttgggccccagaccccagggcagggtgggcagcctatgggggctctcggaaatggaatgtgcccctggcccatctcagcctcctgagcctgtgggtccccactcaccccctttgctgtgaggaatgctctgtgccagaaacagtgggagccctgaccttggctgactggggctggggtgagagaggaaagacctacattccctctcctgcccagatgccctttggaaagccattgaccacccaccatattgtttgatctacttcatagctccttggagcaggcaaaaaagggacagcatgccccttggctggatcagggaatccagctccctagactgcatcccgtacctcttcccatgactgcacccagctccaggggcccttgggacagccagagctgggtggggacagtgataggcccaaggtcccctccacatcccagcagcccaagcttaatagccctccccctcaacctcaccattgtgaagcacctactatgtgctgggtgcctcccacacttgctggggctcacggggcctccaacccatttaatcaccatgggaaactgttgtgggcgctgcttccaggataaggagactgaggcttagagagaggaggcagccccctccacaccagtggcctcgtggttattagcaaggctgggtaatgtgaaggcccaagagcagagtctgggcctctgactctgagtccactgctccatttataaccccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaagccataggcccaggatatttctgagagtgaaaccatgactgtgaccaccttctgtccccagccctgtcctggttccttcctatgcccaggtaccacccttcagaccccagttctaggggagaagagccctggacacccctgctctacccatgagcctgcccgctgcaatgcctagacttcccaacagccttagctgccagtgctggtcactaaccaacaaggttggcaccccagctaccccttctttgcagggctaaggcccccaaacatagcccctgccccggaggaagcttggggaacccatgagttgtcagctttgactttatctcctgctctttctacatgactgggcctcccttgggctggaagaattggggattctctattggaggtgagatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaaaaaaaaaaaaaaaaa

SEQ ID NO: 1248 - DNA, 3983 bp, Homo sapiens
ggatccggaagcacaggagaccaagagaccagagataccaggatgagagataggacccctggttgccaggttcgagaagtcctaggctgagtccctggaaatggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctgagaagagcgttcctctttgcatcctctatgagaaataccgtgactgccttacggagtccaacctcatcaaggtgcgggccctcctcgtggagccagttatcaacagctacctgctggctgagagggacctctacctggagaatccagaaatcaagatccggatccttggggagcccaagcagaaacgcaagctggtggctgaggtgtccctgcagaacccgctccctgtggccctggaaggctgcaccttcactgtggagggggccggcctgactgaggagcagaagacggtggagatcccagaccccgtggaggcaggggaggaagttaaggtgagaatggacctgctgccgctccacatgggcctccacaagctggtggtgaacttcgagagcgacaagctgaaggctgtgaagggcttccggaatgtcatcattggccccgcctaagggacccctgctcccagcctgctgagagcccccaccttgatcccaatccttatcccaagctagtgagcaaaatatgccccttcttgggccccagaccccagggcagggtgggcagcctatgggggctctcggaaatggaatgtgcccctggcccatctcagcctcctgagcctgtgggtccccactcaccccctttgctgtgaggaatgctctgtgccagaaacagtgggagccctgaccttggctgactggggctggggtgagagaggaaagacctacattccctctcctgcccagatgccctttggaaagccattgaccacccaccatattgtttgatctacttcatagctccttggagcaggcaaaaaagggacagcatgccccttggctggatcagggaatccagctccctagactgcatcccgtacctcttcccatgactgcacccagctccaggggcccttgggacagccagagctgggtggggacagtgataggcccaaggtcccctccacatcccagcagcccaagcttaatagccctccccctcaacctcaccattgtgaagcacctactatgtgctgggtgcctcccacacttgctggggctcacggggcctccaacccatttaatcaccatgggaaactgttgtgggcgctgcttccaggataaggagactgaggcttagagagaggaggcagccccctccacaccagtggcctcgtggttattagcaaggctgggtaatgtgaaggcccaagagcagagtctgggcctctgactctgagtccactgctccatttataaccccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaagccataggcccaggatatttctgagagtgaaaccatgactgtgaccaccttctgtccccagccctgtcctggttccttcctatgcccaggtaccacccttcagaccccagttctaggggagaagagccctggacacccctgctctacccatgagcctgcccgctgcaatgcctagacttcccaacagccttagctgccagtgctggtcactaaccaacaaggttggcaccccagctaccccttctttgcagggctaaggcccccaaacatagcccctgccccggaggaagcttggggaacccatgagttgtcagctttgactttatctcctgctctttctacatgactgggcctcccttgggctggaagaattggggattctctattggaggtgagatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaacta

SEQ ID NO: 1249 - DNA, 2217 bp, Homo sapiens
ggatccggaagcacaggagaccaagagaccagagataccaggatgagagataggacccctggttgccaggttcgagaagtcctaggctgagtccctggaaatggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctggtaaagccctgtgttcctggagcatttgttgaccgccaactgacaacatgctaggtagtgacctaaccacttagcatgtgtgatttcaccccacagacacttacatggcgctgactctggggcaggccctgtcctaagcactttataaatatcaacccacttaattcttattgcaagatgaggctggtccaagtcccctgttggaacctccaatgccaagctcaagctgagatgcgttccctctaagcccccatactgtggttgagttacttgttattctttgatgataagatctggggaatttccgtgtgctggtggacaggaagccaggccctggatggctgaaaggaatccagttgcccccacccctgcctcctttctctgctgcttctttctcttctccttcctgcctccaccctttcatgctctctcctccctcatccc

SEQ ID NO: 1250 - DNA, 3882 bp, Homo sapiens
tggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctgagaagagcgttcctctttgcatcctctatgagaaataccgtgactgccttacggagtccaacctcatcaaggtgcgggccctcctcgtggagccagttatcaacagctacctgctggctgagagggacctctacctggagaatccagaaatcaagatccggatccttggggagcccaagcagaaacgcaagctggtggctgaggtgtccctgcagaacccgctccctgtggccctggaaggctgcaccttcactgtggagggggccggcctgactgaggagcagaagacggtggagatcccagaccccgtggaggcaggggaggaagttaaggtgagaatggacctgctgccgctccacatgggcctccacaagctggtggtgaacttcgagagcgacaagctgaaggctgtgaagggcttccggaatgtcatcattggccccgcctaagggacccctgctcccagcctgctgagagcccccaccttgatcccaatccttatcccaagctagtgagcaaaatatgccccttcttgggccccagaccccagggcagggtgggcagcctatgggggctctcggaaatggaatgtgcccctggcccatctcagcctcctgagcctgtgggtccccactcaccccctttgctgtgaggaatgctctgtgccagaaacagtgggagccctgaccttggctgactggggctggggtgagagaggaaagacctacattccctctcctgcccagatgccctttggaaagccattgaccacccaccatattgtttgatctacttcatagctccttggagcaggcaaaaaagggacagcatgccccttggctggatcagggaatccagctccctagactgcatcccgtacctcttcccatgactgcacccagctccaggggcccttgggacagccagagctgggtggggacagtgataggcccaaggtcccctccacatcccagcagcccaagcttaatagccctccccctcaacctcaccattgtgaagcacctactatgtgctgggtgcctcccacacttgctggggctcacggggcctccaacccatttaatcaccatgggaaactgttgtgggcgctgcttccaggataaggagactgaggcttagagagaggaggcagccccctccacaccagtggcctcgtggttattagcaaggctgggtaatgtgaaggcccaagagcagagtctgggcctctgactctgagtccactgctccatttataaccccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaagccataggcccaggatatttctgagagtgaaaccatgactgtgaccaccttctgtccccagccctgtcctggttccttcctatgcccaggtaccacccttcagaccccagttctaggggagaagagccctggacacccctgctctacccatgagcctgcccgctgcaatgcctagacttcccaacagccttagctgccagtgctggtcactaaccaacaaggttggcaccccagctaccccttctttgcagggctaaggcccccaaacatagcccctgccccggaggaagcttggggaacccatgagttgtcagctttgactttatctcctgctctttctacatgactgggcctcccttgggctggaagaattggggattctctattggaggtgagatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaacta

SEQ ID NO: 1251 - DNA, 3613 bp, Homo sapiens
ggatccggaagcacaggagaccaagagaccagagataccaggatgagagataggacccctggttgccaggttcgagaagtcctaggctgagtccctggaaatggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctgagaagagcgttcctctttgcatcctctatgagaaataccgtgactgccttacggagtccaacctcatcaaggtgcgggccctcctcgtggagccagttatcaacagctacctgctggctgagagggacctctacctggagaatccagaaatcaagatccggatccttggggagcccaagcagaaacgcaagctggtggctgaggtgtccctgcagaacccgctccctgtggccctggaaggctgcaccttcactgtggagggggccggcctgactgaggagcagaagacggtggagatcccagaccccgtggaggcaggggaggaagttaaggtgagaatggacctgctgccgctccacatgggcctccacaagctggtggtgaacttcgagagcgacaagctgaaggctgtgaagggcttccggaatgtcatcattggccccgcctaagggacccctgctcccagcctgctgagagcccccaccttgatcccaatccttatcccaagctagtgagcaaaatatgccccttcttgggccccagaccccagggcagggtgggcagcctatgggggctctcggaaatggaatgtgcccctggcccatctcagcctcctgagcctgtgggtccccactcaccccctttgctgtgaggaatgctctgtgccagaaacagtgggagccctgaccttggctgactggggctggggtgagagaggaaagacctacattccctctcctgcccagatgccctttggaaagccattgaccacccaccatattgtttgatctacttcatagctccttggagcaggcaaaaaagggacagcatgccccttggctggatcagggaatccagctccctagactgcatcccgtacctcttcccatgactgcacccagctccaggggcccttgggacagccagagctgggtggggacagtgataggcccaaggtcccctccacatcccagcagcccaagcttaatagccctccccctcaacctcaccattgtgaagcacctactatgtgctgggtgcctcccacacttgctggggctcacggggcctccaacccatttaatcaccatgggaaactgttgtgggcgctgcttccaggataaggagactgaggcttagagagaggaggcagccccctccacaccagtggcctcgtggttattagcaaggctgggtaatgtgaaggcccaagagcagagtctgggcctctgactctgagtccactgctccatttataaccccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaagccataggcccaggatatttctgagaatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaacta

SEQ ID NO: 1252 - DNA, 6794 bp, Homo sapiens
cggccgcgcaggcgcaaaatgtcgcagccgtagggaggctccgcctctgacgcttgccttgcatcacgtggtaatggccgctcaaaaaacgccttagcgaaaaccagagcgtgccctcgtcacgtgatggaggactcccagtacggcaaagggaaggcgccaaaagttgtcagatggcgaaggaaaccgcgaaattcgccattgtcacatgatggagcaacctatcgaaagcggagggaaaggtgccgaagtcacgtgactacgcacgcaaacactcccgcttgcaccacgtgcaactcacgcccaccccctcagccccccccttatctcttttcgcccctccctcccatttgggttgggcctgcgtcgaggcgcaacgcggcgtcaaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagaacgtaaaacagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggtcagttctacagcaacggagggcattctgggaatgccagtggcggtggcggcgggggcggtggtggctcctccggctatggctcctactaccaaggtgacaactacaactcaccggtgcccccaaaacacgctgggaagaagcagccgcacgggggccagcagaagccctcctacggctcgggctaccagtcccaccagggccagcagcagtcctacaaccagagcccctacagcaactatggccctccacagggcaagcagaaaggctataaccatggacaaggcagctactcctactcgaactcctacaactctcccgggggcgggggcggatccgactacaactacgagagcaaattcagtgagttggcttccagagcccctcggccgggccagggtccaggccccagcagtgcagcccacggagtggcagaagctcggcactgcccagacctctggctgagggccttaggaggaggacaagtggtgctggctgcgggcgggtgctaggaagatggggcgtgggacctcatggtgccgtctccgccactctctctggtgtgttctccgaaggcagggtagctgaggcctctgtcccgaggccctggctgtgggtgaggctgcaaggtgacttcctgggacttgctctagagagttttgcatccagcccctgcaagagcctgacctctccgccaccgcctttccgcttcctcatgcgcagacccagcaggcccgggctgcaccagtgacccagtggggctgagtagactacagtggtagtggaggccgaagcggcgggaacagctacggctcaggcggggcatcctacaacccagggtcacacgggggctacggcggaggttctgggggcggctcctcataccaaggcaaacaaggaggctactcacagtcgaactacaactccccggggtccggccagaactacagtggccctcccagctcctaccagtcctcacaaggcggctatggcagaaacgcagaccacagcatgaactaccagtacagataagcccccgcggggcggagatttctaccttctgcacttactccccatcagaagatcgagttttatgcatcacatccacgttgctgtgtcgtgaggtgcagcgggtcaccctgtggcccgtcctgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaaatagttacagaagggatacgtcatttgttaatgcttttgtgaagtgagttaaacgagctttctgtattttaatgctttagtgtttcagttttataagtgaagattttattttaaaaaccagtgggaaagagtggggggtttctttttatgtctgggtcattcaggcagtacatctgaattaagctgaatgtagacaaataaagaaaaacaaaactgcgcccgtcttaggcctgggtgtctgacccaccagcagtgcaatgggcaggtttccccactctattcctgctcttgggaaagcagcgtgggccatcaggatggtccctggtccttagagagggtccagttcaggcttctagacattttactcatgctcagcgaaggctggttcctggtcccctgggctgtgtagacccggtgtcccaccaggctccaggctcccaccatctacagaggggcttacagcgcccattctggtcttggggaacccatcacaaaataggctttttctgctccccgattctggtgtagttctaagtacacagtgatgtcctctgtaggggcgtgcctgtggtggaacataacgcagttacaaaagaaagggcaggtgaggcctgggtaaccccagccatggaccgtcagtggctggagggagcttcgtgtctgtgctggagctgcagcctgctcgccatctggaggctcagtggagtggggagttggggttctcataccagcagatttccctagagcgtgattctcccatctgaggcaatcttgcctcccaggggaaattttgcaatgtttggaggatgttgtcacagctagtagcgggtgctctgggatctggtggatagatgccaaggatgctgtcaagcatactgtactgcccagaacagtggcccatagcagggacctgccctatcaaaatatcaggtgtatggaggtggagtcccaacgctagagcagcccttctcagctccaccctgcccggggagggaggaggagctctggtttcagagcagtgccgggattgcctttccccaggatctgtgtcggccatccaggaagaactgtactggccaagcctgggaccacacgtctgcagagatcctgctctgctggcctgagccccaggccttggcctcctgtgcttgggtaaccatggccactgggaaaagcaaggaccgtgtttgactttcttggagaggtgaaagaggtgaaagaacaagttgtgtgctagaaaacttttgaggaattcttatttgtgttagagcagaggaggtcccagataccaagtggcgcctcccaggaaaggctgggagaagaggtggcctggagtaccccgagatcccagcagcgcacacagtggagggatgaggatggatgggtcctaacccctgattttgatgggatgtgttcatgtcctatctcctctcctggacacattaaggggttgggacaagaagagactcctgtgagatcagcagacctcgtgtttaaggagagaatgcctgcctgcaacactcatggagagggacacttcctggccccacctgctaaatacctccaaactctgggcaggcgcctgcattctcaacacaggacttcccttaacagtttccggatcagtgaccaccaccacgttcaggtttctgaatgcatgcggcacagcaggcacgtgcctggagagaacagctcctgagcacagcacccttggagccctcaccccgctcacgatcctcaccagtgctgatgatgccgtcatgctgctggcctgagacagtatcccagctacaacaggacgacaccgggttcaggaatatgtggctatcaccttgagcactgacagtggccttccaggctagttgccttccaaacgcaggtagccgacctgcaggagggcctacaaacgggcccagcaagagctgggcaacagctggcttgtgaaatgagacaccttgaccaatatgctttgggtggacggtctcctacatgttcagtggaggccaccaggagcatccatgagcggggaaggggtccacacccttacatggcaagttgatacgatggggtgcttggtggatgggccatggaggtccgtgagctggaactgggcacacgccatcccagagggctcaggatgccccaggaaggaaagaagggcaacagactacacgattggacgtgtgtggttgactgggatgaagttggagggaggggcagggccttgcaggggattggtactgatcccagggaggaagtgttggggcttcatgaactaggatgaaaggaggcccctgagccatgacaaggggcacatccaggatttccgccaccctgaatttagtagagctagtaggccctggtcgtcactctgggcagggatgccgtcagccttgagggtcgccacccacctgtgtgttgccctctgtcctggcggggaaacatacaccccttgtctcaccaccaaccttgcttgtgtagtcagcagggctggccctgccccaaggactcactgcatgtacccggacccctaggcctggcctttgcagcatagttgggagcttctggattccatctgcacctgtgagccccatgctggctgtgcactgcgcgggcctgagactgctggatacaatgttgggcaacaactcagccagcctgatggcagcctcagaggcttactctaacccatcccagaataaatggagacttcatgtg

SEQ ID NO: 1253 - DNA, 6058 bp, Homo sapiens
cgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggctacagtcagttctacagcaacggagggcattctgggaatgccagtggcggtggcggcgggggcggtggtggctcctccggctatggctcctactaccaaggtgacaactacaactcaccggtgcccccaaaacacgctgggaagaagcagccgcacgggggccagcagaagccctcctacggctcgggctaccagtcccaccagggccagcagcagtcctacaaccagagcccctacagcaactatggccctccacagggcaagcagaaaggctataaccatggacaaggcagctactcctactcgaactcctacaactctcccgggggcgggggcggatccgactacaactacgagagcaaattcaactacagtggtagtggaggccgaagcggcgggaacagctacggctcaggcggggcatcctacaacccagggtcacacgggggctacggcggaggttctgggggcggctcctcataccaaggcaaacaaggaggctactcacagtcgaactacaactccccggggtccggccagaactacagtggccctcccagctcctaccagtcctcacaaggcggctatggcagaaacgcagaccacagcatgaactaccagtacagataagcccccgcggggcggagatttctaccttctgcacttactccccatcagaagatcgagttttatgcatcacagttaacatgtcagctggccctccaggcccccgcccccatcccgtccacgttgctgtgtcgtgaggtgcagcgggtcaccctgtggcccgtcctgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaaatagttacagaagggatacgtcatttgttaatgcttttgtgaagtgagttaaacgagctttctgtattttaatgctttagtgtttcagttttataagtgaagattttattttaaaaaccagtgggaaagagtggggggtttctttttatgtctgggtcattcaggcagtacatctgaattaagctgaatgtagacaaataaagaaaaacaaaactgcgcccgtcttaggcctgggtgtctgacccaccagcagtgcaatgggcaggtttccccactctattcctgctcttgggaaagcagcgtgggccatcaggatggtccctggtccttagagagggtccagttcaggcttctagacattttactcatgctcagcgaaggctggttcctggtcccctgggctgtgtagacccggtgtcccaccaggctccaggctcccaccatctacagaggggcttacagcgcccattctggtcttggggaacccatcacaaaataggctttttctgctccccgattctggtgtagttctaagtacacagtgatgtcctctgtaggggcgtgcctgtggtggaacataacgcagttacaaaagaaagggcaggtgaggcctgggtaaccccagccatggaccgtcagtggctggagggagcttcgtgtctgtgctggagctgcagcctgctcgccatctggaggctcagtggagtggggagttggggttctcataccagcagatttccctagagcgtgattctcccatctgaggcaatcttgcctcccaggggaaattttgcaatgtttggaggatgttgtcacagctagtagcgggtgctctgggatctggtggatagatgccaaggatgctgtcaagcatactgtactgcccagaacagtggcccatagcagggacctgccctatcaaaatatcaggtgtatggaggtggagtcccaacgctagagcagcccttctcagctccaccctgcccggggagggaggaggagctctggtttcagagcagtgccgggattgcctttccccaggatctgtgtcggccatccaggaagaactgtactggccaagcctgggaccacacgtctgcagagatcctgctctgctggcctgagccccaggccttggcctcctgtgcttgggtaaccatggccactgggaaaagcaaggaccgtgtttgactttcttggagaggtgaaagaggtgaaagaacaagttgtgtgctagaaaacttttgaggaattcttatttgtgttagagcagaggaggtcccagataccaagtggcgcctcccaggaaaggctgggagaagaggtggcctggagtaccccgagatcccagcagcgcacacagtggagggatgaggatggatgggtcctaacccctgattttgatgggatgtgttcatgtcctatctcctctcctggacacattaaggggttgggacaagaagagactcctgtgagatcagcagacctcgtgtttaaggagagaatgcctgcctgcaacactcatggagagggacacttcctggccccacctgctaaatacctccaaactctgggcaggcgcctgcattctcaacacaggacttcccttaacagtttccggatcagtgaccaccaccacgttcaggtttctgaatgcagacccaccacgagggatggattccacccgcccgccctgctgcagatacatgcggcacagcaggcacgtgcctggagagaacagctcctgagcacagcacccttggagccctcaccccgctcacgatcctcaccagtgctgatgatgccgtcatgctgctggcctgagacagtatcccagctacaacaggacgacaccgggttcaggaatatgtggctatcaccttgagcactgacagtggccttccaggctagttgccttccaaacgcaggtagccgacctgcaggagggcctacaaacgggcccagcaagagctgggcaacagctggcttgtgaaatgagacaccttgaccaatatgctttgggtggacggtctcctacatgttcagtggaggccaccaggagcatccatgagcggggaaggggtccacacccttacatggcaagttgatacgatggggtgcttggtggatgggccatggaggtccgtgagctggaactgggcacacgccatcccagagggctcaggatgccccaggaaggaaagaagggcaacagactacacgattggacgtgtgtggttgactgggatgaagttggagggaggggcagggccttgcaggggattggtactgatcccagggaggaagtgttggggcttcatgaactaggatgaaaggaggcccctgagccatgacaaggggcacatccaggatttccgccaccctgaatttagtagagctagtaggccctggtcgtcactctgggcagggatgccgtcagccttgagggtcgccacccacctgtgtgttgccctctgtcctggcagggaaacatacaccccttgtctcaccaccaaccttgcttgtgtagtcagcagggctggccctgccccaaggactcactgcatgtacccggacccctaggcctggcctttgcagcatagttgggagcttctggattccatctgcacctgtgagccccatgctggctgtgcactgcgcgggcctgagactgctggatacaatgttgggcaacaactcagccagcctgatggcagcctcagaggcttactctaacccatcccagaataaatggagacttcatgtgttcattgtttcattcactcaa

SEQ ID NO: 1254 - DNA, 3242 bp, Homo sapiens
atgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagtgcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactctgcgacagcaggctacagtcagttctacagcaacggagggcattctgggaatgccagtggcggtggcggcgggggcggtggtggctcctccggctatggctcctactaccaaggtgacaactacaactcaccggtgcccccaaaacacgctgggaagaagcagccgcacgggggccagcagaagccctcctacggctcgggctaccagtcccaccagggccagcagcagtcctacaaccagagcccctacagcaactatggccctccacagggcaagcagaaaggctataaccatggacaaggcagctactcctactcgaactcctacaactctcccgggggcgggggcggatccgactacaactacgagagcaaattcaactacagtggtagtggaggccgaagcggcgggaacagctacggctcaggcggggcatcctacaacccagggtcacacgggggctacggcggaggttctgggggcggctcctcataccaaggcaaacaaggaggctactcacagtcgaactacaactccccggggtccggccagaactacagtggccctcccagctcctaccagtcctcacaaggcggctatggcagaaacgcagaccacagcatgaactaccagtacagataagcccccgcggggcggagatttctaccttctgcacttactccccatcagaagatcgagttttatgcatcacagttaacatgtcagctggccctccaggcccccgcccccatcccgtccacgttgctgtgtcgtgaggtgcagcgggtcaccctgtggcccgtcctgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaaatagttacagaagggatacgtcatttgttaatgcttttgtgaagtgagttaaacgagctttctgtattttaatgctttagtgtttcagtttttataagtgaagattttattttaaaaaccagtgggaaagagtggggggtttctttttatgtctgggtcattcaggcagtacatctgaattaagctgaatgtagacaaataaagaaaaacaaaactaaaaaaaaaaaaaaaaaaaaaa

SEQ ID NO: 1255 - DNA, 3234 bp, Homo sapiens
cgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggctacacaggttttgtatgaatttttaaccttttaacaaactcccaaatctggttgatgcctttgacagtgatgaaaacgatttcaccacatctgaatccagagaaaccggctttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacagctgcagatgcatgggattctggatttttttgttgctttttagtttaatgggactttaaaagtaattgaggagaaagaaccgtgatgttccctgtttctccagtaaaggactggcttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaagc

SEQ ID NO: 1256 - DNA, 5051 bp, Homo sapiens
cggccgcgcaggcgcaaaatgtcgcagccgtagggaggctccgcctctgacgcttgccttgcatcacgtggtaatggccgctcaaaaaacgccttagcgaaaaccagagcgtgccctcgtcacgtgatggaggactcccagtacggcaaagggaaggcgccaaaagttgtcagatggcgaaggaaaccgcgaaattcgccattgtcacatgatggagcaacctatcgaaagcggagggaaaggtgccgaagtcacgtgactacgcacgcaaacactcccgcttgcaccacgtgcaactcacgcccaccccctcagccccccccttatctcttttcgcccctccctcccatttgggttgggcctgcgtcgaggcgcaacgcggcgtcaaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggctacagtaactggccctccaggcccccgcccccatcccgtccacgttgctgtgtcgtgaggtgcagcgggtcaccctgtggcccgtcctgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaaatagttacagaagggatacgtcatttgttaatgcttttgtgaagtgagttaaacgagctttctgtattttaatgctttagtgtttcagttttataagtgaagattttattttaaaaaccagtgggaaagagtggggggtttctttttatgtctgggtcattcaggcagtacatctgaattaagctgaatgtagacaaataaagaaaaacaaaactgcgcccgtcttaggcctgggtgtctgacccaccagcagtgcaatgggcaggtttccccactctattcctgctcttgggaaagcagcgtgggccatcaggatggtccctggtccttagagagggtccagttcaggcttctagacattttactcatgctcagcgaaggctggttcctggtcccctgggctgtgtagacccggtgtcccaccaggctccaggctcccaccatctacagaggggcttacagcgcccattctggtcttggggaacccatcacaaaataggctttttctgctccccgattctggtgtagttctaagtacacagtgatgtcctctgtaggggcgtgcctgtggtggaacataacgcagttacaaaagaaagggcaggtgaggcctgggtaaccccagccatggaccgtcagtggctggagggagcttcgtgtctgtgctggagctgcagcctgctcgccatctggaggctcagtggagtggggagttggggttctcataccagcagatttccctagagcgtgattctcccatctgaggcaatcttgcctcccaggggaaattttgcaatgtttggaggatgttgtcacagctagtagcgggtgctctgggatctggtggatagatgccaaggatgctgtcaagcatactgtactgcccagaacagtggcccatagcagggacctgccctatcaaaatatcaggtgtatggaggtggagtcccaacgctagagcagcccttctcagctccaccctgcccggggagggaggaggagctctggtttcagagcagtgccgggattgcctttccccaggatctgtgtcggccatccaggaagaactgtactggccaagcctgggaccacacgtctgcagagatcctgctctgctggcctgagccccaggccttggcctcctgtgcttgggtaaccatggccactgggaaaagcaaggaccgtgtttgactttcttggagaggtgaaagaggtgaaagaacaagttgtgtgctagaaaacttttgaggaattcttatttgtgttagagcagaggaggtcccagataccaagtggcgcctcccaggaaaggctgggagaagaggtggcctggagtaccccgagatcccagcagcgcacacagtggagggatgaggatggatgggtcctaacccctgattttgatgggatgtgttcatgtcctatctcctctcctggacacattaaggggttgggacaagaagagactcctgtgagatcagcagacctcgtgtttaaggagagaatgcctgcctgcaacactcatggagagggacacttcctggccccacctgctaaatacctccaaactctgggcaggcgcctgcattctcaacacaggacttcccttaacagtttccggatcagtgaccaccaccacgttcaggtttctgaatgcatgcggcacagcaggcacgtgcctggagagaacagctcctgagcacagcacccttggagccctcaccccgctcacgatcctcaccagtgctgatgatgccgtcatgctgctggcctgagacagtatcccagctacaacaggacgacaccgggttcaggaatatgtggctatcaccttgagcactgacagtggccttccaggctagttgccttccaaacgcaggtagccgacctgcaggagggcctacaaacgggcccagcaagagctgggcaacagctggcttgtgaaatgagacaccttgaccaatatgctttcccagagggctcaggatgccccaggaaggaaagaagggcaacagactacacgattggacgtgtgtggttgactgggatg

SEQ ID NO: 1257 - DNA, 5774 bp, Homo sapiens
cgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggctacagtcagttctacagcaacggagggcattctgggaatgccagtggcggtggcggcgggggcggtggtggctcctccggctatggctcctactaccaaggtgacaactacaactcaccggtgcccccaaaacacgctgggaagaagcagccgcacgggggccagcagaagccctcctacggctcgggctaccagtcccaccagggccagcagcagtcctacaaccagagcccctacagcaactatggccctccacagggcaagcagaaaggctataaccatggacaaggcagctactcctactcgaactcctacaactctcccgggggcgggggcggatccgactacaactacgagagcaaattcaactacagtggtagtggaggccgaagcggcgggaacagctacggctcaggcggggcatcctacaacccagggtcacacgggggctacggcggaggttctgggggcggctcctcataccaaggcaaacaaggaggctactcacagtcgaactacaactccccggggtccggccagaactacagtggccctcccagctcctaccagtcctcacaaggcggctatggcagaaacgcagaccacagcatgaactaccagtacagataagcccccgcggggcggagatttctaccttctgcacttactccccatcagaagatcgagttttatgcatcacagttaacatgtcagctggccctccaggcccccgcccccatcccgtccacgttgctgtgtcgtgaggtgcagcgggtcaccctgtggcccgtcctgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaaatagttacagaagggatacgtcatttgttaatgcttttgtgaagtgagttaaacgagctttctgtattttaatgctttagtgtttcagttttataagtgaagattttattttaaaaaccagtgggaaagagtggggggtttctttttatgtctgggtcattcaggcagtacatctgaattaagctgaatgtagacaaataaagaaaaacaaaactgcgcccgtcttaggcctgggtgtctgacccaccagcagtgcaatgggcaggtttccccactctattcctgctcttgggaaagcagcgtgggccatcaggatggtccctggtccttagagagggtccagttcaggcttctagacattttactcatgctcagcgaaggctggttcctggtcccctgggctgtgtagacccggtgtcccaccaggctccaggctcccaccatctacagaggggcttacagcgcccattctggtcttggggaacccatcacaaaataggctttttctgctccccgattctggtgtagttctaagtacacagtgatgtcctctgtaggggcgtgcctgtggtggaacataacgcagttacaaaagaaagggcaggtgaggcctgggtaaccccagccatggaccgtcagtggctggagggagcttcgtgtctgtgctggagctgcagcctgctcgccatctggaggctcagtggagtggggagttggggttctcataccagcagatttccctagagcgtgattctcccatctgaggcaatcttgcctcccaggggaaattttgcaatgtttggaggatgttgtcacagctagtagcgggtgctctgggatctggtggatagatgccaaggatgctgtcaagcatactgtactgcccagaacagtggcccatagcagggacctgccctatcaaaatatcaggtgtatggaggtggagtcccaacgctagagcagcccttctcagctccaccctgcccggggagggaggaggagctctggtttcagagcagtgccgggattgcctttccccaggatctgtgtcggccatccaggaagaactgtactggccaagcctgggaccacacgtctgcagagatcctgctctgctggcctgagccccaggccttggcctcctgtgcttgggtaaccatggccactgggaaaagcaaggaccgtgtttgactttcttggagaggtgaaagaggtgaaagaacaagttgtgtgctagaaaacttttgaggaattcttatttgtgttagagcagaggaggtcccagataccaagtggcgcctcccaggaaaggctgggagaagaggtggcctggagtaccccgagatcccagcagcgcacacagtggagggatgaggatggatgggtcctaacccctgattttgatgggatgtgttcatgtcctatctcctctcctggacacattaaggggttgggacaagaagagactcctgtgagatcagcagacctcgtgtttaaggagagaatgcctgcctgcaacactcatggagagggacacttcctggccccacctgctaaatacctccaaactctgggcaggcgcctgcattctcaacacaggacttcccttaacagtttccggatcagtgaccaccaccacgttcaggtttctgaatgcagacccaccacgagggatggattccacccgcccgccctgctgcagatacatgcggcacagcaggcacgtgcctggagagaacagctcctgagcacagcacccttggagccctcaccccgctcacgatcctcaccagtgctgatgatgccgtcatgctgctggcctgagacagtatcccagctacaacaggacgacaccgggttcaggaatatgtggctatcaccttgagcactgacagtggccttccaggctagttgccttccaaacgcaggtagccgacctgcaggagggcctacaaacgggcccagcaagagctgggcaacagctggcttgtgaaatgagacaccttgaccaatatgctttgggtggacggtctcctacatgttcagtggaggccaccaggagcatccatgagcggggaaggggtccacacccttacatggcaagttgatacgatggggtgcttggtggatgggccatggaggtccgtgagctggaactgggcacacgccatcccagagggctcaggatgccccaggaaggaaagaagggcaacagactacacgattggacgtgtgtggttgactgggatgaagttggagggaggggcagggccttgcaggggattggtactgatcccagggaggaagtgttggggcttcatgaactaggatgaaaggaggcccctgagccatgacaaggggcacatccaggatttccgccaccctgaatttagtagagctagtaggccctggtcgtcactctgggcagggatgccgtcagccttgagggtcgccacccacctgtgtgttgccctctgtcctggcggggaaacatacaccccttgtctcaccaccaaccttgcttgtgtagtcagcagggctggccctgccccaaggactcactgcatgtacccggacccctaggcctggcctttgcagcatagttgggagcttctggattccatctgcacctgtgagccccatgctggctgtgcactgcgcgggcctgagactgctggatacaatgttgggcaacaactcagccagcctgatggcagcctcagaggcttactctaacccatcccagaataaatggagacttcatgtgttcatt

SEQ ID NO: 1258 - DNA, 5757 bp, Homo sapiens
cggccgcgcaggcgcaaaatgtcgcagccgtagggaggctccgcctctgacgcttgccttgcatcacgtggtaatggccgctcaaaaaacgccttagcgaaaaccagagcgtgccctcgtcacgtgatggaggactcccagtacggcaaagggaaggcgccaaaagttgtcagatggcgaaggaaaccgcgaaattcgccattgtcacatgatggagcaacctatcgaaagcggagggaaaggtgccgaagtcacgtgactacgcacgcaaacactcccgcttgcaccacgtgcaactcacgcccaccccctcagccccccccttatctcttttcgcccctccctcccatttgggttgggcctgcgtcgaggcgcaacgcggcgtcaaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggctacagtcagttctacagcaacggagggcattctgggaatgccagtggcggtggcggcgggggcggtggtggctcctccggctatggctcctactaccaaggtgacaactacaactcaccggtgcccccaaaacacgctgggaagaagcagccgcacgggggccagcagaagccctcctacggctcgggctaccagtcccaccagggccagcagcagtcctacaaccagagcccctacagcaactatggccctccacagggcaagcagaaaggctataaccatggacaaggcagctactcctactcgaactcctacaactctcccgggggcgggggcggatccgactacaactacgagagcaaattcaactacagtggtagtggaggccgaagcggcgggaacagctacggctcaggcggggcatcctacaacccagggtcacacgggggctacggcggaggttctgggggcggctcctcataccaaggcaaacaaggaggctactcacagtcgaactacaactccccggggtccggccagaactacagtggccctcccagctcctaccagtcctcacaaggcggctatggcagaaacgcagaccacagcatgaactaccagtacagataagcccccgcggggcggagatttctaccttctgcacttactccccatcagaagatcgagttttatgcatcacagttaacatgtcagctggccctccaggcccccgcccccatcccgtccacgttgctgtgtcgtgaggtgcagcgggtcaccctgtggcccgtcctgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaaatagttacagaagggatacgtcatttgttaatgcttttgtgaagtgagttaaacgagctttctgtattttaatgctttagtgtttcagttttataagtgaagattttattttaaaaaccagtgggaaagagtggggggtttctttttatgtctgggtcattcaggcagtacatctgaattaagctgaatgtagacaaataaagaaaaacaaaactgcgcccgtcttaggcctgggtgtctgacccaccagcagtgcaatgggcaggtttccccactctattcctgctcttgggaaagcagcgtgggccatcaggatggtccctggtccttagagagggtccagttcaggcttctagacattttactcatgctcagcgaaggctggttcctggtcccctgggctgtgtagacccggtgtcccaccaggctccaggctcccaccatctacagaggggcttacagcgcccattctggtcttggggaacccatcacaaaataggctttttctgctccccgattctggtgtagttctaagtacacagtgatgtcctctgtaggggcgtgcctgtggtggaacataacgcagttacaaaagaaagggcaggtgaggcctgggtaaccccagccatggaccgtcagtggctggagggagcttcgtgtctgtgctggagctgcagcctgctcgccatctggaggctcagtggagtggggagttggggttctcataccagcagatttccctagagcgtgattctcccatctgaggcaatcttgcctcccaggggaaattttgcaatgtttggaggatgttgtcacagctagtagcgggtgctctgggatctggtggatagatgccaaggatgctgtcaagcatactgtactgcccagaacagtggcccatagcagggacctgccctatcaaaatatcaggtgtatggaggtggagtcccaacgctagagcagcccttctcagctccaccctgcccggggagggaggaggagctctggtttcagagcagtgccgggattgcctttccccaggatctgtgtcggccatccaggaagaactgtactggccaagcctgggaccacacgtctgcagagatcctgctctgctggcctgagccccaggccttggcctcctgtgcttgggtaaccatggccactgggaaaagcaaggaccgtgtttgactttcttggagaggtgaaagaggtgaaagaacaagttgtgtgctagaaaacttttgaggaattcttatttgtgttagagcagaggaggtcccagataccaagtggcgcctcccaggaaaggctgggagaagaggtggcctggagtaccccgagatcccagcagcgcacacagtggagggatgaggatggatgggtcctaacccctgattttgatgggatgtgttcatgtcctatctcctctcctggacacattaaggggttgggacaagaagagactcctgtgagatcagcagacctcgtgtttaaggagagaatgcctgcctgcaacactcatggagagggacacttcctggccccacctgctaaatacctccaaactctgggcaggcgcctgcattctcaacacaggacttcccttaacagtttccggatcagtgaccaccaccacgttcaggtttctgaatgcatgcggcacagcaggcacgtgcctggagagaacagctcctgagcacagcacccttggagccctcaccccgctcacgatcctcaccagtgctgatgatgccgtcatgctgctggcctgagacagtatcccagctacaacaggacgacaccgggttcaggaatatgtggctatcaccttgagcactgacagtggccttccaggctagttgccttccaaacgcaggtagccgacctgcaggagggcctacaaacgggcccagcaagagctgggcaacagctggcttgtgaaatgagacaccttgaccaatatgctttcccagagggctcaggatgccccaggaaggaaagaagggcaacagactacacgattggacgtgtgtggttgactgggatg

SEQ ID NO: 1259 - DNA, 3728 bp, Homo sapiens
cggccgcgcaggcgcaaaatgtcgcagccgtagggaggctccgcctctgacgcttgccttgcatcacgtggtaatggccgctcaaaaaacgccttagcgaaaaccagagcgtgccctcgtcacgtgatggaggactcccagtacggcaaagggaaggcgccaaaagttgtcagatggcgaaggaaaccgcgaaattcgccattgtcacatgatggagcaacctatcgaaagcggagggaaaggtgccgaagtcacgtgactacgcacgcaaacactcccgcttgcaccacgtgcaactcacgcccaccccctcagccccccccttatctcttttcgcccctccctcccatttgggttgggcctgcgtcgaggcgcaacgcggcgtcaaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggctacagtgactttttcacagactgctacggctatcatgattttgggtcttcctagagcgtctaaaagtattgcacacaaaatcaactttttactccaatttcctccaactccaaaacccaaagtgtccgtgctgtgtccctgtgcttcactgggtttctcaaccgtggcttttcaccgcagcttgtctgaaactcttagcctgcagaatttaagacaatggcagtttttatcgtgatttgcctttgaacttggtcctattgaagttcacaataagtggaaaacaattttttcagagaatgtatttttgtgcagaattgcacagaattctagagacagcgttgttcggcatcaaggcaaaagcccacctttgctttttatggaaagcattactttatttaaagagacagacaatgacgcattttaatctacctttgtcttaatttacagcaggttttgtatgaatttttaaccttttaacaaactcccaaatctggttgatgcctttgacagtgatgaaaacaaaggactggcttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaa

SEQ ID NO: 1260 - DNA, 6492 bp, Homo sapiens
cggccgcgcaggcgcaaaatgtcgcagccgtagggaggctccgcctctgacgcttgccttgcatcacgtggtaatggccgctcaaaaaacgccttagcgaaaaccagagcgtgccctcgtcacgtgatggaggactcccagtacggcaaagggaaggcgccaaaagttgtcagatggcgaaggaaaccgcgaaattcgccattgtcacatgatggagcaacctatcgaaagcggagggaaaggtgccgaagtcacgtgactacgcacgcaaacactcccgcttgcaccacgtgcaactcacgcccaccccctcagccccccccttatctcttttcgcccctccctcccatttgggttgggcctgcgtcgaggcgcaacgcggcgtcaaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagaacgtaaaacagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggctacagtcagttctacagcaacggagggcattctgggaatgccagtggcggtggcggcgggggcggtggtggctcctccggctatggctcctactaccaaggtgacaactacaactcaccggtgcccccaaaacacgctgggaagaagcagccgcacgggggccagcagaagccctcctacggctcgggctaccagtcccaccagggccagcagcagtcctacaaccagagcccctacagcaactatggccctccacagggcaagcagaaaggctataaccatggacaaggcagctactcctactcgaactcctacaactctcccgggggcgggggcggatccgactacaactacgagagcaaattcaactacagtggtagtggaggccgaagcggcgggaacagctacggctcaggcggggcatcctacaacccagggtcacacgggggctacggcggaggttctgggggcggctcctcataccaaggcaaacaaggaggctactcacagtcgaactacaactccccggggtccggccagaactacagtggccctcccagctcctaccagtcctcacaaggcggctatggcagaaacgcagaccacagcatgaactaccagtacagataagcccccgcggggcggagatttctaccttctgcacttactccccatcagaagatcgagttttatgcatcacagttaacatgtcagctggccctccaggcccccgcccccatcccgtccacgttgctgtgtcgtgaggtgcagcgggtcaccctgtggcccgtcctgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaaatagttacagaagggatacgtcatttgttaatgcttttgtgaagtgagttaaacgagctttctgtattttaatgctttagtgtttcagttttataagtgaagattttattttaaaaaccagtgggaaagagtggggggtttctttttatgtctgggtcattcaggcagtacatctgaattaagctgaatgtagacaaataaagaaaaacaaaactgcgcccgtcttaggcctgggtgtctgacccaccagcagtgcaatgggcaggtttccccactctattcctgctcttgggaaagcagcgtgggccatcaggatggtccctggtccttagagagggtccagttcaggcttctagacattttactcatgctcagcgaaggctggttcctggtcccctgggctgtgtagacccggtgtcccaccaggctccaggctcccaccatctacagaggggcttacagcgcccattctggtcttggggaacccatcacaaaataggctttttctgctccccgattctggtgtagttctaagtacacagtgatgtcctctgtaggggcgtgcctgtggtggaacataacgcagttacaaaagaaagggcaggtgaggcctgggtaaccccagccatggaccgtcagtggctggagggagcttcgtgtctgtgctggagctgcagcctgctcgccatctggaggctcagtggagtggggagttggggttctcataccagcagatttccctagagcgtgattctcccatctgaggcaatcttgcctcccaggggaaattttgcaatgtttggaggatgttgtcacagctagtagcgggtgctctgggatctggtggatagatgccaaggatgctgtcaagcatactgtactgcccagaacagtggcccatagcagggacctgccctatcaaaatatcaggtgtatggaggtggagtcccaacgctagagcagcccttctcagctccaccctgcccggggagggaggaggagctctggtttcagagcagtgccgggattgcctttccccaggatctgtgtcggccatccaggaagaactgtactggccaagcctgggaccacacgtctgcagagatcctgctctgctggcctgagccccaggccttggcctcctgtgcttgggtaaccatggccactgggaaaagcaaggaccgtgtttgactttcttggagaggtgaaagaggtgaaagaacaagttgtgtgctagaaaacttttgaggaattcttatttgtgttagagcagaggaggtcccagataccaagtggcgcctcccaggaaaggctgggagaagaggtggcctggagtaccccgagatcccagcagcgcacacagtggagggatgaggatggatgggtcctaacccctgattttgatgggatgtgttcatgtcctatctcctctcctggacacattaaggggttgggacaagaagagactcctgtgagatcagcagacctcgtgtttaaggagagaatgcctgcctgcaacactcatggagagggacacttcctggccccacctgctaaatacctccaaactctgggcaggcgcctgcattctcaacacaggacttcccttaacagtttccggatcagtgaccaccaccacgttcaggtttctgaatgcagacccaccacgagggatggattccacccgcccgccctgctgcagatacatgcggcacagcaggcacgtgcctggagagaacagctcctgagcacagcacccttggagccctcaccccgctcacgatcctcaccagtgctgatgatgccgtcatgctgctggcctgagacagtatcccagctacaacaggacgacaccgggttcaggaatatgtggctatcaccttgagcactgacagtggccttccaggctagttgccttccaaacgcaggtagccgacctgcaggagggcctacaaacgggcccagcaagagctgggcaacagctggcttgtgaaatgagacaccttgaccaatatgctttgggtggacggtctcctacatgttcagtggaggccaccaggagcatccatgagcggggaaggggtccacacccttacatggcaagttgatacgatggggtgcttggtggatgggccatggaggtccgtgagctggaactgggcacacgccatcccagagggctcaggatgccccaggaaggaaagaagggcaacagactacacgattggacgtgtgtggttgactgggatgaagttggagggaggggcagggccttgcaggggattggtactgatcccagggaggaagtgttggggcttcatgaactaggatgaaaggaggcccctgagccatgacaaggggcacatccaggatttccgccaccctgaatttagtagagctagtaggccctggtcgtcactctgggcagggatgccgtcagccttgagggtcgccacccacctgtgtgttgccctctgtcctggcggggaaacatacaccccttgtctcaccaccaaccttgcttgtgtagtcagcagggctggccctgccccaaggactcactgcatgtacccggacccctaggcctggcctttgcagcatagttgggagcttctggattccatctgcacctgtgagccccatgctggctgtgcactgcgcgggcctgagactgctggatacaatgttgggcaacaactcagccagcctgatggcagcctcagaggcttactctaacccatcccagaataaatggagacttcatgtgttcatt

SEQ ID NO: 1261 - DNA, 6480 bp, Homo sapiens
cggccgcgcaggcgcaaaatgtcgcagccgtagggaggctccgcctctgacgcttgccttgcatcacgtggtaatggccgctcaaaaaacgccttagcgaaaaccagagcgtgccctcgtcacgtgatggaggactcccagtacggcaaagggaaggcgccaaaagttgtcagatggcgaaggaaaccgcgaaattcgccattgtcacatgatggagcaacctatcgaaagcggagggaaaggtgccgaagtcacgtgactacgcacgcaaacactcccgcttgcaccacgtgcaactcacgcccaccccctcagccccccccttatctcttttcgcccctccctcccatttgggttgggcctgcgtcgaggcgcaacgcggcgtcaaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggctacagtcagttctacagcaacggagggcattctgggaatgccagtggcggtggcggcgggggcggtggtggctcctccggctatggctcctactaccaaggtgacaactacaactcaccggtgcccccaaaacacgctgggaagaagcagccgcacgggggccagcagaagccctcctacggctcgggctaccagtcccaccagggccagcagcagtcctacaaccagagcccctacagcaactatggccctccacagggcaagcagaaaggctataaccatggacaaggcagctactcctactcgaactcctacaactctcccgggggcgggggcggatccgactacaactacgagagcaaattcaactacagtggtagtggaggccgaagcggcgggaacagctacggctcaggcggggcatcctacaacccagggtcacacgggggctacggcggaggttctgggggcggctcctcataccaaggcaaacaaggaggctactcacagtcgaactacaactccccggggtccggccagaactacagtggccctcccagctcctaccagtcctcacaaggcggctatggcagaaacgcagaccacagcatgaactaccagtacagataagcccccgcggggcggagatttctaccttctgcacttactccccatcagaagatcgagttttatgcatcacagttaacatgtcagctggccctccaggcccccgcccccatcccgtccacgttgctgtgtcgtgaggtgcagcgggtcaccctgtggcccgtcctgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaaatagttacagaagggatacgtcatttgttaatgcttttgtgaagtgagttaaacgagctttctgtattttaatgctttagtgtttcagttttataagtgaagattttattttaaaaaccagtgggaaagagtggggggtttctttttatgtctgggtcattcaggcagtacatctgaattaagctgaatgtagacaaataaagaaaaacaaaactgcgcccgtcttaggcctgggtgtctgacccaccagcagtgcaatgggcaggtttccccactctattcctgctcttgggaaagcagcgtgggccatcaggatggtccctggtccttagagagggtccagttcaggcttctagacattttactcatgctcagcgaaggctggttcctggtcccctgggctgtgtagacccggtgtcccaccaggctccaggctcccaccatctacagaggggcttacagcgcccattctggtcttggggaacccatcacaaaataggctttttctgctccccgattctggtgtagttctaagtacacagtgatgtcctctgtaggggcgtgcctgtggtggaacataacgcagttacaaaagaaagggcaggtgaggcctgggtaaccccagccatggaccgtcagtggctggagggagcttcgtgtctgtgctggagctgcagcctgctcgccatctggaggctcagtggagtggggagttggggttctcataccagcagatttccctagagcgtgattctcccatctgaggcaatcttgcctcccaggggaaattttgcaatgtttggaggatgttgtcacagctagtagcgggtgctctgggatctggtggatagatgccaaggatgctgtcaagcatactgtactgcccagaacagtggcccatagcagggacctgccctatcaaaatatcaggtgtatggaggtggagtcccaacgctagagcagcccttctcagctccaccctgcccggggagggaggaggagctctggtttcagagcagtgccgggattgcctttccccaggatctgtgtcggccatccaggaagaactgtactggccaagcctgggaccacacgtctgcagagatcctgctctgctggcctgagccccaggccttggcctcctgtgcttgggtaaccatggccactgggaaaagcaaggaccgtgtttgactttcttggagaggtgaaagaggtgaaagaacaagttgtgtgctagaaaacttttgaggaattcttatttgtgttagagcagaggaggtcccagataccaagtggcgcctcccaggaaaggctgggagaagaggtggcctggagtaccccgagatcccagcagcgcacacagtggagggatgaggatggatgggtcctaacccctgattttgatgggatgtgttcatgtcctatctcctctcctggacacattaaggggttgggacaagaagagactcctgtgagatcagcagacctcgtgtttaaggagagaatgcctgcctgcaacactcatggagagggacacttcctggccccacctgctaaatacctccaaactctgggcaggcgcctgcattctcaacacaggacttcccttaacagtttccggatcagtgaccaccaccacgttcaggtttctgaatgcagacccaccacgagggatggattccacccgcccgccctgctgcagatacatgcggcacagcaggcacgtgcctggagagaacagctcctgagcacagcacccttggagccctcaccccgctcacgatcctcaccagtgctgatgatgccgtcatgctgctggcctgagacagtatcccagctacaacaggacgacaccgggttcaggaatatgtggctatcaccttgagcactgacagtggccttccaggctagttgccttccaaacgcaggtagccgacctgcaggagggcctacaaacgggcccagcaagagctgggcaacagctggcttgtgaaatgagacaccttgaccaatatgctttgggtggacggtctcctacatgttcagtggaggccaccaggagcatccatgagcggggaaggggtccacacccttacatggcaagttgatacgatggggtgcttggtggatgggccatggaggtccgtgagctggaactgggcacacgccatcccagagggctcaggatgccccaggaaggaaagaagggcaacagactacacgattggacgtgtgtggttgactgggatgaagttggagggaggggcagggccttgcaggggattggtactgatcccagggaggaagtgttggggcttcatgaactaggatgaaaggaggcccctgagccatgacaaggggcacatccaggatttccgccaccctgaatttagtagagctagtaggccctggtcgtcactctgggcagggatgccgtcagccttgagggtcgccacccacctgtgtgttgccctctgtcctggcggggaaacatacaccccttgtctcaccaccaaccttgcttgtgtagtcagcagggctggccctgccccaaggactcactgcatgtacccggacccctaggcctggcctttgcagcatagttgggagcttctggattccatctgcacctgtgagccccatgctggctgtgcactgcgcgggcctgagactgctggatacaatgttgggcaacaactcagccagcctgatggcagcctcagaggcttactctaacccatcccagaataaatggagacttcatgtgttcatt

SEQ ID NO: 1262 - DNA, 2628 bp, Homo sapiens
agctgggctttgtggagcgctgcggagggtgcgtgcgggccgcggcagccgaacaaaggagcaggggcgccgccgcagggacccgccacccacctcccggggccgcgcagcggcctctcgtctactgccaccatgaccgccaacggcacagccgaggcggtgcagatccagttcggcctcatcaactgcggcaacaagtacctgacggccgaggcgttcgggttcaaggtgaacgcgtccgccagcagcctgaagaagaagcagatctggacgctggagcagccccctgacgaggcgggcagcgcggccgtgtgcctgcgcagccacctgggccgctacctggcggcggacaaggacggcaacgtgacctgcgagcgcgaggtgcccggtcccgactgccgtttcctcatcgtggcgcacgacgacggtcgctggtcgctgcagtccgaggcgcaccggcgctacttcggcggcaccgaggaccgcctgtcctgcttcgcgcagacggtgtcccccgccgagaagtggagcgtgcacatcgccatgcaccctcaggtcaacatctacagcgtcacccgtaagcgctacgcgcacctgagcgcgcggccggccgacgagatcgccgtggaccgcgacgtgccctggggcgtcgactcgctcatcaccctcgccttccaggaccagcgctacagcgtgcagaccgccgaccaccgcttcctgcgccacgacgggcgcctggtggcgcgccccgagccggccactggctacacgctggagttccgctccggcaaggtggccttccgcgactgcgagggccgttacctggcgccgtcggggcccagcggcacgctcaaggcgggcaaggccaccaaggtgggcaaggacgagctctttgctctggagcagagctgcgcccaggtcgtgctgcaggcggccaacgagaggaacgtgtccacgcgccagggtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagaatgccagctgctactttgacatcgagtggcgtgaccggcgcatcacactgagggcgtccaatggcaagtttgtgacctccaagaagaatgggcagctggccgcctcggtggagacagcagactccacaggcaaatactggacggtgggcagtgactccgcggtcaccagcagcggcgacactcctgtggacttcttcttcgagttctgcgactataacaaggtggccatcaaggtgggcgggcgctacctgaagggcgaccacgcaggcgtcctgaaggcctcggcggaaaccgtggaccccgcctcgctctgggagtactagggccggcccgtccttccccgcccctgcccacatggcggctcctgccaaccctccctgctaaccccttctccgccaggtgggctccagggcgggaggcaagcccccttgcctttcaaactggaaaccccagagaaaacggtgcccccacctgtcgcccctatggactccccactctcccctccgcccgggttccctactcccctcgggtcagcggctgcggcctggccctgggagggatttcagatgcccctgccctcttgtctgccacggggcgagtctggcacctctttcttctgacctcagacggctctgagccttatttctctggaagcggctaagggacggttgggggctgggagccctgggcgtgtagtgtaactggaatcttttgcctctcccagccacctcctcccagccccccaggagagctgggcacatgtcccaagcctgtcagtggccctccctggtgcactgtccccgaaacccctgcttgggaagggaagctgtcgggtgggctaggactgacccttgtggtgtttttttgggtggtggctggaaacagcccctctcccacgtggcagaggctcagcctggctcccttccctggagcggcagggcgtgacggccacagggtctgcccgctgcacgttctgccaaggtggtggtggcgggcgggtaggggtgtgggggccgtcttcctcctgtctctttcctttcaccctagcctgactggaagcagaaaatgaccaaatcagtattttttttaatgaaatattattgctggaggcgtcccaggcaagcctggctgtagtagcgagtgatctggcggggggcgtctcagcaccctccccagggggtgcatctcagccccctctttccgtccttcccgtccagccccagccctgggcctgggctgccgacacctgggccagagcccctgctgtgattggtgctccctgggcctcccgggtggatgaagccaggcgtcgccccctccgggagccctggggtgagccgccggggcccccctgctgccagcctcccccgtccccaacatgcatctcactctgggtgtcttggtcttttattttttgtaagtgtcatttgtataactctaaacgcccatgatagtagcttcaaactggaaatagcgaaataaaataactcagtctgcagccccag

SEQ ID NO: 1263 - DNA, 2800 bp, Homo sapiens
agctgggctttgtggagcgctgcggagggtgcgtgcgggccgcggcagccgaacaaaggagcaggggcgccgccgcagggacccgccacccacctcccggggccgcgcagcggcctctcgtctactgccaccatgaccgccaacggcacagccgaggcggtgcagatccagttcggcctcatcaactgcggcaacaagtacctgacggccgaggcgttcgggttcaaggtgaacgcgtccgccagcagcctgaagaagaagcagatctggacgctggagcagccccctgacgaggcgggcagcgcggccgtgtgcctgcgcagccacctgggccgctacctggcggcggacaaggacggcaacgtgacctgcgagcgcgaggtgcccggtcccgactgccgtttcctcatcgtggcgcacgacgacggtcgctggtcgctgcagtccgaggcgcaccggcgctacttcggcggcaccgaggaccgcctgtcctgcttcgcgcagacggtgtcccccgccgagaagtggagcgtgcacatcgccatgcaccctcaggtcaacatctacagcgtcacccgtaagcgctacgcgcacctgagcgcgcggccggccgacgagatcgccgtggaccgcgacgtgccctggggcgtcgactcgctcatcaccctcgccttccaggaccagcgctacagcgtgcagaccgccgaccaccgcttcctgcgccacgacgggcgcctggtggcgcgccccgagccggccactggctacacgctggagttccgctccggcaaggtggccttccgcgactgcgagggccgttacctggcgccgtcggggcccagcggcacgctcaaggcgggcaaggccaccaaggtgggcaaggacgagctctttgctctggagcagagctgcgcccaggtcgtgctgcaggcggccaacgagaggaacgtgtccacgcgccagggtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagaatgccagctgctactttgacatcgagtggcgtgaccggcgcatcacactgagggcgtccaatggcaagtttgtgacctccaagaagaatgggcagctggccgcctcggtggagacagcaggggactcagagctcttcctcatgaagctcatcaaccgccccatcatcgtgttccgcggggagcatggcttcatcggctgccgcaaggtcacgggcaccctggacgccaaccgctccagctatgacgtcttccagctggagttcaacgatggcgcctacaacatcaaaggcagactccacaggcaaatactggacggtgggcagtgactccgcggtcaccagcagcggcgacactcctgtggacttcttcttcgagttctgcgactataacaaggtggccatcaaggtgggcgggcgctacctgaagggcgaccacgcaggcgtcctgaaggcctcggcggaaaccgtggaccccgcctcgctctgggagtactagggccggcccgtccttccccgcccctgcccacatggcggctcctgccaaccctccctgctaaccccttctccgccaggtgggctccagggcgggaggcaagcccccttgcctttcaaactggaaaccccagagaaaacggtgcccccacctgtcgcccctatggactccccactctcccctccgcccgggttccctactcccctcgggtcagcggctgcggcctggccctgggagggatttcagatgcccctgccctcttgtctgccacggggcgagtctggcacctctttcttctgacctcagacggctctgagccttatttctctggaagcggctaagggacggttgggggctgggagccctgggcgtgtagtgtaactggaatcttttgcctctcccagccacctcctcccagccccccaggagagctgggcacatgtcccaagcctgtcagtggccctccctggtgcactgtccccgaaacccctgcttgggaagggaagctgtcgggtgggctaggactgacccttgtggtgtttttttgggtggtggctggaaacagcccctctcccacgtggcagaggctcagcctggctcccttccctggagcggcagggcgtgacggccacagggtctgcccgctgcacgttctgccaaggtggtggtggcgggcgggtaggggtgtgggggccgtcttcctcctgtctctttcctttcaccctagcctgactggaagcagaaaatgaccaaatcagtattttttttaatgaaatattattgctggaggcgtcccaggcaagcctggctgtagtagcgagtgatctggcggggggcgtctcagcaccctccccagggggtgcatctcagccccctctttccgtccttcccgtccagccccagccctgggcctgggctgccgacacctgggccagagcccctgctgtgattggtgctccctgggcctcccgggtggatgaagccaggcgtcgccccctccgggagccctggggtgagccgccggggcccccctgctgccagcctcccccgtccccaacatgcatctcactctgggtgtcttggtcttttattttttgtaagtgtcatttgtataactctaaacgcccatgatagtagcttcaaactggaaatagcgaaataaaataactcagtctgcagccccag

SEQ ID NO: 1264 - DNA, 2616 bp, Homo sapiens
ggtggagcgctgcgggaggtgcgtgcgcgccccggccgccgaacaaaggagcaggggcgccgccgcggggacccgccacccacctcccggggccgcgccgcggcctcccgtccaccgccaccatgaccgccaacggcacagccgaggcggtgcagatccggttcggcctcatcaactgcggcaacaagtacctgagggcggaggcgttcgggttcaaggttaacgcgtcggccagcagcctgaagaagcagcagatctggacgctggagcagccccctgactaggcgggcagcgcggccgtgtgcctgcgcagccacctgggccgctacctggcggcggacaaggacggcaatgtgacctgcgagcgcgaggtgcccggtcccgactgccgcttcctcaccgtggcgcacgacgacggccgctggtcgctgcagtccgaggcgcaccggcgctccttcggcggcacggaggaccgcctgtcgtgcttcgcgcagacggtgtcccccgccgagaagtggagcgtgcacatcgccatgcaccctcaggtcaacatctaccgcgtcacccctaagcgctaggcgcacctgagcgcgccgccggccgacgagatcgcagtggaccgcgacgtgccctggggcgtcgactcgctcgtcaccctcgccttccaggagcagcgctacagcgtgcagaccgcggaccaccgcttcctgcgccatgacaggcgcctggtggcgcgccccgagccggccactggctacacgctgcagttccgctccggcaatgtggccttccgcgactgcgagggccgttacctggcgccgtcggggcccagcggcacgctcaaggcgggcaaggccaccaaggtgggcaaggacgagctctttgccctggagcagagctgcgcccaggtcgtgctgcaggcggccaacgggaggaatgtgtccacgcgccagggtatggacctgtctgccaatccggacgaggagaccgaccaggagaccttccagctggagatcgaccgcgacaacaacaagtgtgccttctgtacccacaggggcaagtactggacgctgacggccactgggggcgtgcagtccaccgcctccaccaagaatgccagctgctacttcgacattgagcggcgtgaccggcgcatcacactgcgggcgtccaatggcaagtttgtgacatctaagaagaatgggcagctggccgcctcggtggagacagcaggggatccacaggcaaatactggacggtgggcagtgactccgcggtcaccagcagcggcgacactcctgtggacttcttcttcgagttctgcgactacaacaaggaggccatcaagatggacgggcgctacctgaagggcgaccacgcaggggtcctaagggcctccgcggagaccgtgcaccccgcctcgctctgggagtactagggcccgcccgcccttcccggttcctgcccacgtggcggctccttccaaccctccctgctaaccccttctcctccaggtgggctcccccgggcgggaggcaagcccccttgcctttcaaactggaaaccccagagaaaacggtgcccccacctgtcgcccctatggacttcccagtctcccctccgccctggttccctactcccctcgggtcagcggctgcggcctggccctgggagggatttcagatgcccctgccctcttgtctgccacggggcgagtctggcacctctttcttctgacctcagacggctctgagccttatttctctggaagcggctaagggacggttgggggctgggagccctgggcgtgtagtgtaactggaatctcttgcccctcccagccacctcctcccagccccccaggagctgggcacgtgtcccaagcctgtcagtggccctccctggtgcactgtcccgaaacccctgcttgggaagggaagccgtcaggtgggcgaggactgagcctcggtgtttttttgggtggtggctggaaacagcccctctcccacgtggcagaggctcagcctggctcccttccctggagcggcagggtgtgacggccacagggtctgcccgctgcatgttctgccagggtggtggtggcgggggggtaggggtgtgggggccgtcttcctcctctttcctttcaccctagcctgaccggaagcagaaaatgaccaaatcggtatttttttttaatgaaatattattgctggaggcgtcccaggcaagcctggctgtagtagtgagtgatgtgggtggggcgtctcagcaccctccccagggggtgcatctcagccccctctttccgtccttccggtccagccccagccctgggcctgggctgcggatgcctgggccagagcccccgctgtgattggtgcttcctgggcctcctgggtggatgaagccaggcgtcgccccctcggggagccctggggtgagccgccagggcccccctgctgccagtctcccccgtcccgtccccgacatgcatctcactctgggtgtcctggtcttttattttttgtaagtgtcatttgtataactccaaacgcccatgatagtagcttcaaactggaaatagtgaaataaaataactcagtctgcagctcc

SEQ ID NO: 1265 - DNA, 2781 bp, Homo sapiens
ggtggagcgctgcgggaggtgcgtgcgcgccccggccgccgaacaaaggagcaggggcgccgccgcggggacccgccacccacctcccggggccgcgccgcggcctcccgtccaccgccaccatgaccgccaacggcacagccgaggcggtgcagatccggttcggcctcatcaactgcggcaacaagtacctgagggcggaggcgttcgggttcaaggttaacgcgtcggccagcagcctgaagaagcagcagatctggacgctggagcagccccctgactaggcgggcagcgcggccgtgtgcctgcgcagccacctgggccgctacctggcggcggacaaggacggcaatgtgacctgcgagcgcgaggtgcccggtcccgactgccgcttcctcaccgtggcgcacgacgacggccgctggtcgctgcagtccgaggcgcaccggcgctccttcggcggcacggaggaccgcctgtcgtgcttcgcgcagacggtgtcccccgccgagaagtggagcgtgcacatcgccatgcaccctcaggtcaacatctaccgcgtcacccctaagcgctaggcgcacctgagcgcgccgccggccgacgagatcgcagtggaccgcgacgtgccctggggcgtcgactcgctcgtcaccctcgccttccaggagcagcgctacagcgtgcagaccgcggaccaccgcttcctgcgccatgacaggcgcctggtggcgcgccccgagccggccactggctacacgctgcagttccgctccggcaatgtggccttccgcgactgcgagggccgttacctggcgccgtcggggcccagcggcacgctcaaggcgggcaaggccaccaaggtgggcaaggacgagctctttgccctggagcagagctgcgcccaggtcgtgctgcaggcggccaacgggaggaatgtgtccacgcgccagggtatggacctgtctgccaatccggacgaggagaccgaccaggagaccttccagctggagatcgaccgcgacaacaacaagtgtgccttctgtacccacaggggcaagtactggacgctgacggccactgggggcgtgcagtccaccgcctccaccaagaatgccagctgctacttcgacattgagcggcgtgaccggcgcatcacactgcgggcgtccaatggcaagtttgtgacatctaagaagaatgggcagctggccgcctcggtggagacagcaggggactcagagctcttcctcatgaagttcatcaaccgcgccatcaccgtgttgcgcggggagcacggctttatcggctgccgcaaggtcggggcaccctggacgccaaccgctgcagctatgacgtcttccagctggagttcaacaatggtacctacaacatcaaagactccacaggcaaatactggacggtgggcagtgactccgcggtcaccagcagcggcgacactcctgtggacttcttcttcgagttctgcgactacaacaaggaggccatcaagatggacgggcgctacctgaagggcgaccacgcaggggtcctaagggcctccgcggagaccgtgcaccccgcctcgctctgggagtactagggcccgcccgcccttcccggttcctgcccacgtggcggctccttccaaccctccctgctaaccccttctcctccaggtgggctcccccgggcgggaggcaagcccccttgcctttcaaactggaaaccccagagaaaacggtgcccccacctgtcgcccctatggacttcccagtctcccctccgccctggttccctactcccctcgggtcagcggctgcggcctggccctgggagggatttcagatgcccctgccctcttgtctgccacggggcgagtctggcacctctttcttctgacctcagacggctctgagccttatttctctggaagcggctaagggacggttgggggctgggagccctgggcgtgtagtgtaactggaatctcttgcccctcccagccacctcctcccagccccccaggagctgggcacgtgtcccaagcctgtcagtggccctccctggtgcactgtcccgaaacccctgcttgggaagggaagccgtcaggtgggcgaggactgagcctcggtgtttttttgggtggtggctggaaacagcccctctcccacgtggcagaggctcagcctggctcccttccctggagcggcagggtgtgacggccacagggtctgcccgctgcatgttctgccagggtggtggtggcgggggggtaggggtgtgggggccgtcttcctcctctttcctttcaccctagcctgaccggaagcagaaaatgaccaaatcggtatttttttttaatgaaatattattgctggaggcgtcccaggcaagcctggctgtagtagtgagtgatgtgggtggggcgtctcagcaccctccccagggggtgcatctcagccccctctttccgtccttccggtccagccccagccctgggcctgggctgcggatgcctgggccagagcccccgctgtgattggtgcttcctgggcctcctgggtggatgaagccaggcgtcgccccctcggggagccctggggtgagccgccagggcccccctgctgccagtctcccccgtcccgtccccgacatgcatctcactctgggtgtcctggtcttttattttttgtaagtgtcatttgtataactccaaacgcccatgatagtagcttcaaactggaaatagtgaaataaaataactcagtctgcagctcc

SEQ ID NO: 1266 - DNA, 2390 bp, Homo sapiens
gcggagggtgcgtgcgggccgcggcagccgaacaaaggagcaggggcgccgccgcagggacccgccacccacctcccggggccgcgcagcggcctctcgtctactgccaccatgaccgccaacggcacagccgaggcggtgcagatccagttcggcctcatcaactgcggcaacaagtacctgacggccgaggcgttcgggttcaaggtgaacgcgtccgccagcagcctgaagaagaagcagatctggacgctggagcagccccctgacgaggcgggcagcgcggccgtgtgcctgcgcagccacctgggccgctacctggcggcggacaaggacggcaacgtgacctgcgagcgcgaggtgcccggtcccgactgccgtttcctcatcgtggcgcacgacgacggtcgctggtcgctgcagtccgaggcgcaccggcgctacttcggcggcaccgaggaccgcctgtcctgcttcgcgcagacggtgtcccccgccgagaagtggagcgtgcacatcgccatgcaccctcaggtcaacatctacagcgtcacccgtaagcgctacgcgcacctgagcgcgcggccggccgacgagatcgccgtggaccgcgacgtgccctggggcgtcgactcgctcatcaccctcgccttccaggaccagcgctacagcgtgcagaccgccgaccaccgcttcctgcgccacgacgggcgcctggtggcgcgccccgagccggccactggctacacgctggagttccgctccggcaaggtggccttccgcgactgcgagggccgttacctggcgccgtcggggcccagcggcacgctcaaggcgggcaaggccaccaaggtgggcaaggacgagctctttgctctggagcagagctgcgcccaggtcgtgctgcaggcggccaacgagaggaacgtgtccacgcgccagggtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagaatgccagctgctactttgacatcgagtggcgtgaccggcgcatcacactgagggcgtccaatggcaagtttgtgacctccaagaagaatgggcagctggccgcctcggtggagacagcaggggactcagagctcttcctcatgaagctcatcaaccgccccatcatcgtgttccgcggggagcatggcttcatcggctgccgcaaggtcacgggcaccctggacgccaaccgctccagctatgacgtcttccagctggagttcaacgatggcgcctacaacatcaaagactccacaggcaaatactggacggtgggcagtgactccgcggtcaccagcagcggcgacactcctgtggacttcttcttcgagttctgcgactataacaaggtggccatcaaggtgggcgggcgctacctgaagggcgaccacgcaggcgtcctgaaggcctcggcggaaaccgtggaccccgcctcgctctgggagtactagggccggcccgtccttccccgcccctgcccacatggcggctcctgccaaccctccctgctaaccccttctccgccaggtgggctccagggcgggaggcaagcccccttgcctttcaaactggaaaccccagagaaaacggtgcccccacctgtcgcccctatggactccccactctcccctccgcccgggttccctactcccctcgggtcagcggctgcggcctggccctgggagggatttcagatgcccctgccctcttgtctgccacggggcgagtctggcacctctttcttctgacctcagacggctctgagccttatttctctggaagcggctaagggacggttgggggctgggagccctgggcgtgtagtgtaactggaatcttttgcctctcccagccacctcctcccagccccccaggagagctgggcacatgtcccaagcctgtcagtggccctccctggtgcactgtccccgaaacccctgcttgggaagggaagctgtcgggtgggctaggactgacccttgtggtgtttttttgggtggtggctggaaacagcccctctcccgggtggatgaagccaggcgtcgccccctccgggagccctggggtgagccgccggggcccccctgctgccagcctcccccgtccccaacatgcatctcactctgggtgtcttggtcttttattttttgtaagtgtcatttgtataactctaaacgcccatgatagtagcttcaaactggaaatagcgaaataaaataactcagtctgcaaaaaaaaaaaaaaaaaa

SEQ ID NO: 1267 - DNA, 2796 bp, Homo sapiens
agctgggctttgtggagcgctgcggagggtgcgtgcgggccgcggcagccgaacaaaggagcaggggcgccgccgcagggacccgccacccacctcccggggccgcgcagcggcctctcgtctactgccaccatgaccgccaacggcacagccgaggcggtgcagatccagttcggcctcatcaactgcggcaacaagtacctgacggccgaggcgttcgggttcaaggtgaacgcgtccgccagcagcctgaagaagaagcagatctggacgctggagcagccccctgacgaggcgggcagcgcggccgtgtgcctgcgcagccacctgggccgctacctggcggcggacaaggacggcaacgtgacctgcgagcgcgaggtgcccggtcccgactgccgtttcctcatcgtggcgcacgacgacggtcgctggtcgctgcagtccgaggcgcaccggcgctacttcggcggcaccgaggaccgcctgtcctgcttcgcgcagacggtgtcccccgccgagaagtggagcgtgcacatcgccatgcaccctcaggtcaacatctacagcgtcacccgtaagcgctacgcgcacctgagcgcgcggccggccgacgagatcgccgtggaccgcgacgtgccctggggcgtcgactcgctcatcaccctcgccttccaggaccagcgctacagcgtgcagaccgccgaccaccgcttcctgcgccacgacgggcgcctggtggcgcgccccgagccggccactggctacacgctggagttccgctccggcaaggtggccttccgcgactgcgagggccgttacctggcgccgtcggggcccagcggcacgctcaaggcgggcaaggccaccaaggtgggcaaggacgagctctttgctctggagcagagctgcgcccaggtcgtgctgcaggcggccaacgagaggaacgtgtccacgcgccagggtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagaatgccagctgctactttgacatcgagtggcgtgaccggcgcatcacactgagggcgtccaatggcaagtttgtgacctccaagaagaatgggcagctggccgcctcggtggagacagcaggggactcagagctcttcctcatgaagctcatcaaccgccccatcatcgtgttccgcggggagcatggcttcatcggctgccgcaaggtcacgggcaccctggacgccaaccgctccagctatgacgtcttccagctggagttcaacgatggcgcctacaacatcaaagactccacaggcaaatactggacggtgggcagtgactccgcggtcaccagcagcggcgacactcctgtggacttcttcttcgagttctgcgactataacaaggtggccatcaaggtgggcgggcgctacctgaagggcgaccacgcaggcgtcctgaaggcctcggcggaaaccgtggaccccgcctcgctctgggagtactagggccggcccgtccttccccgcccctgcccacatggcggctcctgccaaccctccctgctaaccccttctccgccaggtgggctccagggcgggaggcaagcccccttgcctttcaaactggaaaccccagagaaaacggtgcccccacctgtcgcccctatggactccccactctcccctccgcccgggttccctactcccctcgggtcagcggctgcggcctggccctgggagggatttcagatgcccctgccctcttgtctgccacggggcgagtctggcacctctttcttctgacctcagacggctctgagccttatttctctggaagcggctaagggacggttgggggctgggagccctgggcgtgtagtgtaactggaatcttttgcctctcccagccacctcctcccagccccccaggagagctgggcacatgtcccaagcctgtcagtggccctccctggtgcactgtccccgaaacccctgcttgggaagggaagctgtcgggtgggctaggactgacccttgtggtgtttttttgggtggtggctggaaacagcccctctcccacgtggcagaggctcagcctggctcccttccctggagcggcagggcgtgacggccacagggtctgcccgctgcacgttctgccaaggtggtggtggcgggcgggtaggggtgtgggggccgtcttcctcctgtctctttcctttcaccctagcctgactggaagcagaaaatgaccaaatcagtattttttttaatgaaatattattgctggaggcgtcccaggcaagcctggctgtagtagcgagtgatctggcggggggcgtctcagcaccctccccagggggtgcatctcagccccctctttccgtccttcccgtccagccccagccctgggcctgggctgccgacacctgggccagagcccctgctgtgattggtgctccctgggcctcccgggtggatgaagccaggcgtcgccccctccgggagccctggggtgagccgccggggcccccctgctgccagcctcccccgtccccaacatgcatctcactctgggtgtcttggtcttttattttttgtaagtgtcatttgtataactctaaacgcccatgatagtagcttcaaactggaaatagcgaaataaaataactcagtctgcagccccag

SEQ ID NO: 1268 - DNA, 1237 bp, Homo sapiens
gccgagaggagaggagaatggcggcggaaggctggatttggcgttggggctggggccggcggtgcctgggaaggcctgggcttctcggccccggccctggccccactacacctctctttcttcttttgttgttggggtctgtgactgcggatataactgacggcaacagtgaacatctcaagcgggagcattcgctcattaagccctaccaaggggtcggttccagctctatgcccctctgggacttccagggcagcactatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagggcctgtgtttggaagcaaagataacttccacggcttagccatcttcctggacacctaccccaatgatgagaccactgagcgcgtgttcccgtacatctcggtgatggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgatgaccgacctggaggacaagaacgagtggaagaactgcattgacatcacgggagtgcgcctgcccaccggctactacttcggggcctccgccggcaccggcgacctgtctgacaatcatgacatcatctccatgaagctgttccagctgatggtggagcacacgcccgacgaggagagcatcgactggaccaagatcgagcccagcgtcaacttcctcaagtcgcccaaagacaacgtggacgaccccacggggaacttccgcagcgggcccctgacggggtggcgggtgttcctgctgctgctgtgcgctctcctgggcatcgttgtctgcgccgtggtgggggccgtggtgttccagaagcggcaggagcggaacaagcgcttctactgagtggcgcctccggcggggcctgtccctgggcccaggagccaatgtgaacttttttttttaccgggattataaaagaacaacaagatgaccttatttcttaactgtttcaaataaatgattaaagtattttcaaaaaaaaaaaaaaaaaa

SEQ ID NO: 1269 - DNA, 1238 bp, Homo sapiens
ttggggtctgtgactgcggatataactgacgacggcatcgccttgtggtacacccgggaccgcctcgtgccagggcctgtgtttggaagcaaagataacttccacggcttagccatcttcctggacacctaccccaatgatgagaccactgagcgcgtgttcccgtacatctcggtgatggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgatgaccgacctggaggacaagaacgagtggaagaactgcattgacatcacgggagtgcgcctgcccaccggctactacttcggggcctccgccggcaccggcgacctgtctgacaatcatgacatcatctccatgaagctgttccagctgatggtggagcacacgcccgacgaggagagcatcgactggaccaagatcgagcccagcgtcaacttcctcaagtcgcccaaagacaacgtggacgaccccacggggaacttccgcagcgggcccctgacggggtggcgggtgttcctgctgctgctgtgcgctctcctgggcatcgttgtctgcgccgtggtgggggccgtggtgttccagaagcggcaggagcggaacaagcgcttctactgagtggcgcctccggcggggcctgtccctgggcccaggagccaatgtgaacttttttttttaccgggattataaaagaacaacaagatgaccttatttcttaactgtttcaaataaatgattaaagtattttcatacattttgcttcttgcccagcagggacaggtggcagagccgaggcttagggtctggcaccccccacagctggagacggaggctctcctggggctggtgtctcaggagcaggggtctgtgtctacagatgggctgtggcccctgcaggcagctgttgaacactggagggtcccccggaccacactggggtgggctcctgaggacgtggggaagtgattttgttttgtggtgtgtggcacgtgtggcgacggataaggcctgaactgggaaacccaggccttcctgttcaccctgagctgcttcctgagacagatgctcaagtgaggctgcaggcgcggtgtggtggggccgagtgtgaccgtttgctaaataaagtgaaatacccaacctcagcc

SEQ ID NO: 1270 - DNA, 1806 bp, Homo sapiens
tgccttggagcctctaaggagatgaaactgcactcaaccaggatgagaggctgcccggccaatgcagctgccgccccgtctgctgcggaggctttgctttttgactccctggcgacagtaaagttgaagagcttccggccggaggccaatagatgggacccccggaaggcggaagttctagggcggaagtggccgagaggagaggagaatggcggcggaaggctggatttggcgttggggctggggccggcggtgcctgggaaggcctgggcttctcggccccggccctggccccactacacctctctttcttcttttgttgttggggtctgtgactgcggatataactgacggcaacagtgaacatctcaagcgggagcattcgctcattaagccctaccaaggggtcggttccagctctatgcccctctgggacttccagggcagcactatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagggcctgtgtttggaagcaaagataacttccacggcttagccatcttcctggacacctaccccaatgatgagaccactgagcgcgtgttcccgtacatctcggtgatggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgatgaccgacctggaggacaagaacgagtggaagaactgcattgacatcacgggagtgcgcctgcccaccggctactacttcggggcctccgccggcaccggcgacctgtctgacaatcatgacatcatctccatgaagctgttccagctgatggtggagcacacgcccgacgaggagagcatcgactggaccaagatcgagcccagcgtcaacttcctcaagtcgcccaaagacaacgtggacgaccccacggggaacttccgcagcgggcccctgacggggtggcgggtgttcctgctgctgctgtgcgctctcctgggcatcgttgtctgcgccgtggtgggggccgtggtgttccagaagcggcaggagcggaacaagcgcttctactgagtggcgcctccggcggggcctgtccctgggcccaggagccaatgtgaacttttttttttaccgggattataaaagaacaacaagatgaccttatttcttaactgtttcaaataaatgattaaagtattttcatacattttgcttcttgcccagcagggacaggtggcagagccgaggcttagggtctggcaccccccacagctggagacggaggctctcctggggctggtgtctcaggagcaggggtctgtgtctacagatgggctgtggcccctgcaggcagctgttgaacactggagggtcccccggaccacactggggtgggctcctgaggacgtggggaagtgattttgttttgtggtgtgtggcacgtgtggcgacggataaggcctgaactgggaaacccaggccttcctgttcaccctgagctgcttcctgagacagatgctcaagtgaggctgcaggcgcggtgtggtggggccgagtgtgaccgtttgctaaataaagtgaaatacccaacctcagcc

SEQ ID NO: 1271 - DNA, 2884 bp, Homo sapiens
tcgattctcaagagggtttcattggtctcaacctggccccccaggcaacccacccctgattggacagtctcatcaagaaggttggtcaagagctcaagtgtttctgagaatctgggtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgctgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctgct

SEQ ID NO: 1272 - DNA, 3030 bp, Homo sapiens
caatgaccagctaatggctcgattctcaagagggtttcattggtctcaacctggccccccaggcaacccacccctgattggacagtctcatcaagaaggttggtcaagagctcaagtgtttctgagaatctgggtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctggagtgtagtatttgttaaacaggtgaatctacttctcttaacaaagtctcaatgtcctatttgcaatttatgtggtaaacactgaagacaatggtccttaaccttttggcatctcagcctcctttcgaaagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgctgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctg

SEQ ID NO: 1273 - DNA, 2703 bp, Homo sapiens
cggacgcccaggagacagccggttgctgagccgggagcgctgactggcccggctgggcaggggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgctgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctg

SEQ ID NO: 1274 - DNA, 1855 bp, Homo sapiens
cctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtgatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgttgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgt

SEQ ID NO: 1275 - DNA, 2902 bp, Homo sapiens
tgcaatgaccagctaatggctcgattctcaagagggtttcattggtctcaacctggccccccaggcaacccacccctgattggacagtctcatcaagaaggttggtcaagagctcaagtgtttctgagaatctgggtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgctgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctg

SEQ ID NO: 1276 - DNA, 2690 bp, Homo sapiens
ctgaaagaaagaggggaagagtattaaagaccatttctggctgggcagggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgctgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctg

SEQ ID NO: 1277 - DNA, 2758 bp, Homo sapiens
gtttccacggacgcccaggagacagccggttgctgagccgggagcgctgactggcccggctgggcaggctgaaagaaagaggggaagagtattaaagaccatttctggctgggcagggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgctgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctg

SEQ ID NO: 1278 - DNA, 1961 bp, Homo sapiens
acagccggttgctgagccgggagcgctgactggcccggctgggcagggtgaatctacttctcttaacaaagtctcaatgtcctatttgcaatttatgtggtaaacactgaagacaatggtccttaaccttttggcatctcagcctcctttcgaaagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgctgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgccaccctgttcttgtccatggaggactccgagggttccaagtatactcttaagacccactctgtttaaaaatatatattctatgtatgcgt

SEQ ID NO: 1279 - DNA, 2932 bp, Homo sapiens
cacagcaagaactgaaacgaatggggattgaactgctttgcctgttctttctatttctaggaaggaatgatcacgtacaaggtggctgtgccctgggaggtgcagaaacctgtgaagactgcctgcttattggacctcagtgtgcctggtgtgctcaggagaattttactcatccatctggagttggcgaaaggtgtgataccccagcaaaccttttagctaaaggatgtcaattaaacttcatcgaaaaccctgtctcccaagtagaaatacttaaaaataagcctctcagtgtaggcagacagaaaaatagttctgacattgttcagattgcgcctcaaagcttgatccttaagttgagaccaggtggtgcgcagactctgcaggtgcatgtccgccagactgaggactacccggtggatttgtattacctcatggacctctccgcctccatggatgacgacctcaacacaataaaggagctgggctcccggctttccaaagagatgtctaaattaaccagcaactttagactgggcttcggatcttttgtggaaaaacctgtatccccttttgtgaaaacaacaccagaagaaattgccaacccttgcagtagtattccatacttctgtttacctacatttggattcaagcacattttgccattgacaaatgatgctgaaagattcaatgaaattgtgaagaatcagaaaatttctgctaatattgacacacccgaaggtggatttgatgcaattatgcaagctgctgtgtgtaaggaaaaaattggctggcggaatgactccctccacctcctggtctttgtgagtgatgctgattctcattttggaatggacagcaaactagcaggcatcgtcattcctaatgacgggctctgtcacttggacagcaagaatgaatactccatgtcaactgtcttggaatatccaacaattggacaactcattgataaactggtacaaaacaacgtgttattgatcttcgctgtaacccaagaacaagttcatttatatgagaattacgcaaaacttattcctggagctacagtaggtctacttcagaaggactccggaaacattctccagctgatcatctcagcttatgaagaactgcggtctgaggtggaactggaagtattaggagacactgaaggactcaacttgtcatttacagccatctgtaacaacggtaccctcttccaacaccaaaagaaatgctctcacatgaaagtgggagacacagcttccttcagcgtgactgtgaatatcccacactgcgagagaagaagcaggcacattatcataaagcctgtggggctgggggatgccctggaattacttgtcagcccagaatgcaactgcgactgtcagaaagaagtggaagtgaacagctccaaatgtcaccacgggaacggctctttccagtgtggggtgtgtgcctgccaccctggccacatggggcctcgctgtgagtgtggcgaggacatgctgagcacagattcctgcaaggaggccccagatcatccctcctgcagcggaaggggtgactgctactgtgggcagtgtatctgccacttgtctccctatggaaacatttatgggccttattgccagtgtgacaatttctcctgcgtgagacacaaagggctgctctgcggaggtaacggcgactgtgactgtggtgaatgtgtgtgcaggagcggctggactggcgagtactgcaactgcaccaccagcacggactcctgcgtctctgaagatggagtgctctgcagcgggcgcggggactgtgtttgtggcaagtgtgtttgcacaaaccctggagcctcaggaccaacctgtgaacgatgtcctacctgtggtgacccctgtaactctaaacggagctgcattgagtgccacctgtcagcagctggccaagcccgagaagaatgtgtggacaagtgcaaactagctggtgcgaccatcagtgaagaagaagatttctcaaaggatggttctgtttcctgctctctgcaaggagaaaatgaatgtcttattacattcctaataactacagataatgaggggaaaaccatcattcacagcatcaatgaaaaagattgtccgaagcctccaaacattcccatgatcatgttaggggtttccctggctattcttctcatcggggttgtcctactgtgcatctggaagctactggtgtcatttcatgatcgtaaagaagttgccaaatttgaagcagaacgatcaaaagccaagtggcaaacgggaaccaatccactctacagaggatccacaagtacttttaaaaatgtaacttataaacacagggaaaaacaaaaggtagacctttccacagattgctagaactactttatgcatgaaaaaagtctgtttcactgatatgaaatgttaatgcactatttaatttttttctctttgttgcttcaaaatgaggttggtttaagataataataggacatctgcagataagtcatcctctacatgaaggtgacagactgttggcagtttcaaaataatcaagaagagaaatatccttagcaaagagatgactttggggatcatttgaggaatactaactctgttgcattaatgcttcaaaaaatcatcaaatgattcatgggggcctgatttgcatttgaaaaatgtttgaaattagagtctcatttgtttcaggaatgcagctacctgagttttttgtctcggcaaagtcacaaagcccatatactcacattgtgtgtctatacttgccaattaattctaaacttgtaggaaatatgccctctcttaaaggagaattttttttaaatctctgagaaatgagattctgagtttatttcagctaaaaggttgcaattcttctgaagatatctcaaatataaggttgaaag

SEQ ID NO: 1280 - DNA, 4408 bp, Homo sapiens
cctggcctcgcgggccgtgtctccggcatcatgtgtggtatatttgcttacttaaactaccatgttcctcgaacgagacgagaaattcctggagaccctaatcaaaggcctcagagactggagtacagagctcatgatggtttaggtgtgggatttgatggaggcaatgataaagattgggaagccaatgcctgcaaaatccagcttattaagaagaaaggaaaagttaaggcactggatgaagaagttcacaagcaacaagatatggatttggatatagaatttgatgtacaccttggaatagctcatacccgttgggcaacacatggagaacccagtcctgtcaatagccacccccagcgctctgataaaaataatgaatttatcgttattcacaatggaatcatcaccaactacaaagacttgaaaaagtttttggaaagcaaaggctatgacttcgaatctgaaacagacacagagacaattgccaagctcgttaagtatatgtatgacaatcgggaaagtcaagataccagctttactaccttggtggagagagttatccaacaattggaaggtgcttttgcacttgtgtttaaaagtgttcattttcccgggcaagcagttggcacaaggcgaggtagccctctgttgattggtgtacggagtgaacataaactttctactgatcacattcctatactctacagaacaggcaaagacaagaaaggaagctgcaatctctctcgtgtggacagcacaacctgccttttcccggtggaagaaaaagcagtggagtattactttgcttctgatgcaagtgctgtcatagaacacaccaatcgcgtcatctttctggaagatgatgatgttgcagcagtagtggatggacgtctttctatccatcgaattaaacgaactgcaggagatcaccccggacgagctgtgcaaacactccagatggaactccagcagatcatgaagggcaacttcagttcatttatgcagaaggaaatatttgagcagccagagtctgtcgtgaacacaatgagaggaagagtcaactttgatgactatactgtgaatttgggtggtttgaaggatcacataaaggagatccagagatgccggcgtttgattcttattgcttgtggaacaagttaccatgctggtgtagcaacacgtcaagttcttgaggagctgactgagttgcctgtgatggtggaactagcaagtgacttcctggacagaaacacaccagtctttcgagatgatgtttgctttttccttagtcaatcaggtgagacagcagatactttgatgggtcttcgttactgtaaggagagaggagctttaactgtggggatcacaaacacagttggcagttccatatcacgggagacagattgtggagttcatattaatgctggtcctgagattggtgtggccagtacaaaggcttataccagccagtttgtatcccttgtgatgtttgcccttatgatgtgtgatgatcggatctccatgcaagaaagacgcaaagagatcatgcttggattgaaacggctgcctgatttgattaaggaagtactgagcatggatgacgaaattcagaaactagcaacagaactttatcatcagaagtcagttctgataatgggacgaggctatcattatgctacttgtcttgaaggggcactgaaaatcaaagaaattacttatatgcactctgaaggcatccttgctggtgaattgaaacatggccctctggctttggtggataaattgatgcctgtgatcatgatcatcatgagagatcacacttatgccaagtgtcagaatgctcttcagcaagtggttgctcggcaggggcggcctgtggtaatttgtgataaggaggatactgagaccattaagaacacaaaaagaacgatcaaggtgccccactcagtggactgcttgcagggcattctcagcgtgatccctttacagttgctggctttccaccttgctgtgctgagaggctatgatgttgatttcccacggaatcttgccaaatctgtgactgtagagtgaggaatatctatacaaaatgtacgaaactgtatgattaagcaacacaagacaccttttgtatttaaaaccttgatttaaaatatcaccccttgaagcctttttttagtaaatccttatttatatatcagttataattattccactcaatatgtgatttttgtgaagttacctcttacattttcccagtaatttgtggaggactttgaataatggaatctatattggaatctgtatcagaaagattctagctattattttctttaaagaatgctgggtgttgcatttctggaccctccacttcaatctgagaagacaatatgtttctaaaaattggtacttgtttcaccatacttcattcagaccagtgaaagagtagtgcatttaattggagtatctaaagccagtggcagtgtatgctcatacttggacagttagggaagggtttgccaagttttaagagaagatgtgatttattttgaaatttgtttctgttttgtttttaaatcaaactgtaaaacttaaaactgaaaaattttattggtaggatttatatctaagtttggttagccttagtttctcagacttgttgtctattatctgtaggtggaagaaatttaggaagcgaaatattacagtagtgcattggtgggtctcaatccttaacatatttgcacaattttatagcacaaactttaaattcaagctgctttggacaactgacaatatgattttaaatttgaagatgggatgtgtacatgttgggtatcctactactttgtgttttcatctcctaaaagtggtttttatttccttgtatctgtagtcttttattttttaaatgactgctgaatgacatattttatcttgttctttaaaatcacaacacagagctgctattaaattaatattgatatattcagtattctcttcaactttgtcacgaggaagaatttcctgtagttaattttaactttccttcattacattgttgcataaaactagtcccttagtgccagtttggaagttacttgcaattgtttggaagatttgcaggtcgctgacctcatcatttcactctaagtatatgtggtaggctaagctcagaaaaaggtatgtatgctttacactgataggcaccaaatttagtattgtatcctaagtatttttcctcttctgtattttctgtgctctacccctgaaatatatttaggaataaagaagatataaataaagtgatattggggtatgttcagcttgtaagtgtcagaaatggaagttgacaatttggattaaaatatttaaagtagaatgttattatttgatacccccaaaattgtgagtaataatttcttaatggagcttttctggccagatcttcagggctataggagagtgtgtttgtttttggtgaagtccttctttttcaaaggtttttacttttaaattgtgaagataagctatttagcacaattatttaagtaagctgttttttcctttcttttctttcttttcttgttttaacttctgggtgaggttaagattttctaatagttattgttgttgccagagaagcatagaattctgcttgtgtcttagggttagagaaagatttgttatattttgaggtaatttggaaggactttcatacatggtgactagaaacctgatctttttaagaataaaatagggtcactatttacattatatataatatatggctattatagctatattaatctactttaattgtttctaagattattttgtgtaagtcagctagcgtgtgtatagtgtcatttcttatgttttgtatattaacgttttacaaacacaatttgtgtgggtttgtagcatttcttatagtttaaagtatgattcagcattctaagttaaaactaatatgtgaagtcagtcattagtctgcataatctctgtctccctctgtgtgtgtctttctataaagcacatgtgtacacacacacacacaaatatactgaaagctagggtaagttctaaactgaatatcaaaaaccaaaatcaagaacaaagaagtgatattttccaaacaaacatggattctctgccgggtgcagtggctcagcctgtaataccagcctccactttgggagtctgaggtgggagtattgcttgagctcaagagttggagaacagcctgggcaacatggtgagacctggtctttacaaaaatttttttggccggacgcagtggctcacacctgtaatcccagcactttgggaggccgaggcaggttgatcatgaggtcaagagatcgagaccatcctggccaacatggtgaaaccccgtctttac

SEQ ID NO: 1281 - DNA, 1260 bp, Homo sapiens
tctatgagaggccatacacggtggacctgactagggtgtggcttccctgaggagctgaagttgcccagaggcccagagaaggggagctgagcacgtttgaaccactgaacctgctctggacctcgcctccttcccttcggtgcctcccagcatcctatcctctttaaagagcaggggttcagggaagttccctggatggtgattcgcaggggcagctcccctctcacctgccgcgatgactaccccgccccatctcaaacacacaagctcacgcatgcgggactggagcccttgaggacatgtggcccaaagacaggaggtacaggggctcagtgcgtgcagtggaatgaactgggcttcatctctggaagggtaaggggccatcttccgggttcaccgccgcatccccacccccggcacagcgcctcctggcgactaacatcggtgacttagtgaaaggactaagaaagacccgaggcgaggccggaacaggccgatttctagccgccaagtggagaacaggttggagcggtgcgccgggcttagcggcggttgctggaggaacgggcggagtcgcccagggtcctgccctgcgggggtcgagccgaggcaggcggtgacttccccactcggggcggagccgcagcctcgcgggggcggggcctggcgccggcggtggcgtcacaaaaggcgggaccacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactagga

SEQ ID NO: 1282 - DNA, 348 bp, Homo sapiens
atgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaa

SEQ ID NO: 1283 - DNA, 561 bp, Homo sapiens
accacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagact

SEQ ID NO: 1284 - DNA, 8971 bp, Homo sapiens
agcccaaaccgcggccctagccccggccgcacccccagcccgcgccagcatgatgaacaacagcggctactcagacgccggcctcggcctgggcgatgagacagacgagatgccgtccacggagaaggacctggcggaggacgcgccgtggaagaagatccagcagaacacattcacgcgctggtgcaatgagcacctcaagtgcgtgggcaagcgcctgaccgacctgcagcgcgacctcagcgacgggctccggctcatcgcgctgctcgaggtgctcagccagaagcgcatgtaccgcaagttccatccgcgccccaacttccgccaaatgaagctggagaacgtgtccgtggccctcgagttcctcgagcgcgagcacatcaagctcgtgtccatagacagcaaggccatcgtggatgggaacctgaagctgatcctgggcctgatctggacgctgatcctgcactactccatctccatgcccatgtgggaggatgaagatgatgaggatgcccgcaaacagacgcccaagcagcggctgcttggctggatccagaacaaggtgccccagctgcccatcaccaacttcaaccgtgactggcaggacggcaaagctctgggcgccctggtggacaactgcgcccccggtctctgccccgactgggaggcctgggatcccaaccagcccgtggagaactcccgggaggccatgcagcaggccgacgactggcttggggtgccccaggtcattgcccctgaggagattgtggaccccaacgtggatgagcattctgttatgacctacctgtcccagttccccaaggccaagctcaaacctggtgcccctgttcgatccaagcagctgaaccccaagaaagccatcgcctatgggcctggcatcgagccacagggcaacaccgtgctgcagcctgcccacttcaccgtgcagacggtggacgcgggcgtgggcgaggtgctggtctacatcgaggaccctgaaggccacaccgaggaggctaaggtggttcccaacaatgacaaggatcgcacctatgctgtctcctatgtgcccaaggtcgctgggttacacaaggtgaccgtgctctttgctggccagaacattgaacgcagtccctttgaggtgaacgtgggcatggccctgggagatgccaacaaggtgtcagcccgtggccctggcctggaacctgtgggcaatgtggccaacaaacccacctactttgacatctacactgcgggggccggcactggcgatgttgctgtggtgatcgtggacccacagggccggcgggacacagtggaggtggccctggaggacaagggtgacagcacgttccgctgcacatacagacctgccatggaggggccacataccgtgcatgtggcctttgcgggtgcccccatcacccgcagtcccttccctgtccatgtgtcggaagcctgtaaccccaacgcctgccgcgcctctgggcgaggcctgcagcccaagggtgttcgcgtgaaagaggtggctgacttcaaggtgtttaccaagggtgccggcagcggggagctcaaggtcacggtcaaggggccaaagggcacagaggagccagtgaaggtgcgggaggctggggatggtgtgttcgagtgcgagtactacccggtggtgcctgggaagtatgtggtgaccatcacgtggggcggctacgccatccctcgcagcccctttgaggtacaggtgagcccagaggcaggagtgcaaaaggtccgggcctggggtcctggtttggagactggccaggtgggcaagtcagccgattttgtggtggaagccattggcaccgaggtggggacactgggcttctccatcgaggggccctcacaagccaagatcgaatgtgacgataagggggatggctcctgcgatgtgcggtactggcccacggagcctggggagtacgctgtgcacgtcatctgtgacgatgaggacatccgagactcacccttcattgcccacatcctgcccgccccacctgactgcttcccagataaggtgaaggcctttgggcctggcctggagcctaccggctgcatcgtggacaagcccgctgagttcaccattgatgctcgtgcagctggcaagggagacctgaagctctatgcccaggacgccgacggctgtcccatcgacatcaaggtgatccccaacggcaacggcaccttccgctgctcctacgtgcccaccaagcccattaagcacaccatcatcatctcctggggaggcgtaaacgtgcccaagagccccttccgggtgaacgtgggcgagggcagccaccccgagcgggtaaaggtgtacggccccggagtggagaagacaggcctcaaggccaatgagcccacctacttcacggtggactgcagcgaggcggggcaaggcgacgtgagcatcggcatcaagtgcgccccaggcgtggtgggccctgcagaggctgacattgacttcgacatcatcaagaatgacaacgacaccttcaccgtcaagtacacgccaccaggggcgggccgctacaccatcatggtgctgtttgccaaccaggagatccccgccagccccttccacatcaaggtggacccatcccacgatgccagcaaagtcaaggccgagggccctgggctgaatcgcacaggtgtggaagtcgggaagcccacccacttcacggtgctgaccaagggagccggcaaggccaagctggatgtgcagtttgcagggacagccaagggcgaggttgtgcgggactttgagatcatagacaaccatgactactcctacactgtcaagtacaccgctgtccagcagggcaacatggcagtgacagtgacttatggcggggaccctgtccccaagagcccctttgtggtgaatgtggcacccccgctggacctcagcaaaatcaaagttcagggccttaatagcaaggtggctgtgggacaggaacaagcattctctgtgaacacacgaggggctggcggtcagggccaactggatgtgcggatgacttcgccctctcgccggcccatcccctgcaagctggagccaggcggtggagcggaagcccaggctgtgcgctacatgcccccggaggaggggccctacaaggtggatatcacctacgatggtcacccggtgcctggcagcccgtttgctgtggagggtgtcctgccccctgatccctccaaggtctgtgcttatggcccgggtctcaagggtggactggtaggcacccccgcgccattctccatcgacaccaagggggctggcacaggtggcctggggctgaccgtagagggcccctgcgaggccaagatcgagtgccaggacaatggtgatggctcatgtgctgtcagctacctgcccacggagcctggcgagtacaccatcaacatcctgtttgctgaggcccacatccctggctcgcccttcaaagccaccattcggcctgtgtttgacccgagcaaggtgcgggccagtggaccgggcctggagcgcggcaaggtcggtgaggcagccaccttcactgtggactgctcagaggcaggcgaggcggagctgaccattgagatcctgtcggatgccggggtcaaggccgaggtgctgatccacaacaacgcggatggcacctaccacatcacctacagccctgccttccctggcacctacaccattaccatcaagtatggcgggcatcccgtgcccaaattccccacccgtgtccatgtgcagcctgcggtcgataccagtggcgtcaaggtctcagggcctggtgttgagccacacggtgtcctgcgggaggtgaccactgagttcactgtggatgcaagatccctaacagccacaggcggcaaccacgtgacggctcgtgtgctcaacccctcgggggccaagacagacacctatgtgacagacaatggggacggcacctaccgagtgcagtacaccgcctacgaggagggcgtgcatctggtggaggtcctgtatgatgaggtcgctgtgcccaagagccccttccgagtgggcgtgaccgagggctgtgatcccacccgcgtccgagccttcgggccaggcctggagggtggcttggtcaacaaggccaaccgattcactgtggagaccaggggagcgggcaccgggggccttggcctagccatcgagggtccctcggaagccaagatgtcctgcaaggacaacaaggatggtagctgcaccgtggagtacatccccttcactcctggagactatgacgtcaacatcaccttcggggggcggcccatcccagggagcccgttccgcgtgccagtgaaggatgtggtggaccctgggaaggtgaagtgctcagggccagggctgggggctggtgtcagggcccgggttcctcagaccttcacagtggactgcagtcaagctggccgggcgcccctgcaggtggctgtgctgggccccacaggtgtggccgagcctgtggaggtgcgggacaatggagatggcacccacactgtccactacaccccagccactgacgggccctacacggtagccgtcaagtatgctgaccaggaggtgccacgcagccccttcaagatcaaggtcctcccagctcatgatgccagcaaggtgcgggccagcgggccaggcctcaacgcctctggcatccctgccagcctgcctgtggagttcaccatcgacgcacgggacgcgggcgaggggttgctcactgtccagatcttgggccccgagggtaagcccaagaaggccaacatccgggacaatggggatggcacgtacgctgtgtcctacctgccggacatgagtggccggtacaccatcaccatcaagtatggcggtgatgagatcccctactcgcccttccgcatccatgctctgcccactggggatgccagcaagtgcctcgtcacagtgtccattggaggccatggcctgggtgcctgcctgggccctcgaatccagattgggcaggagacggtgatcacggtggatgccaaggcagccggtgaggggaaggtgacatgcacggtgtccacgccggatggggcagagctcgatgtggatgtggttgagaaccatgacggtacctttgacatctactacacagcgcccgagccgggcaagtacgtcatcaccatccgcttcgggggtgagcacatccccaacagccccttccacgtgctggcgtgtgaccccctgccgcacgaggaggagccctctgaagtgccacagctgcgccagccctacgctcctccccggcccggcgcccgccccacacactgggccacagaggagccagtggtgcctgtggagccaatggagtccatgctgaggcccttcaacctggtcatccccttcgcggtgcagaaaggggagctcacaggagaggtgcggatgccctcggggaagacggcacggcccaacatcaccgacaacaaggacggcaccatcacggtgaggtatgcacccactgagaaaggcctgcaccagatggggatcaagtatgacggcaaccacatccctgggagccccttacagttctatgtggatgccatcaacagccgccatgtcagtgcctatgggccaggcctgagccatggcatggtcaacaagccagccaccttcactattgtcaccaaagatgctggagaagggggtctgtcactggccgtggagggcccatccaaggcagagatcacctgtaaggacaacaaggatggcacctgcaccgtgtcctatctgccgactgcgcctggagactacagcatcatcgtgcgcttcgatgacaagcacatcccggggagccccttcacagccaagatcacaggtgatgactccatgaggacctcacagctgaatgtgggcacctccacggacgtgtcactgaagatcaccgagagtgatctgagccagctgaccgccagcatccgtgccccctcgggcaacgaggagccctgcctgctgaagcgcctgcccaaccggcacattgggatctccttcacccccaaggaggtcggggagcacgtggtgagcgtgcgcaagagtggcaagcatgtcaccaacagccccttcaagatcctggtggggccatctgagatcggggacgccagcaaggtgcgggtctggggcaaggggctttccgagggacacacattccaggtggcagagttcatcgtggacactcgcaatgcaggttatgggggcttggggctgagtattgaaggcccaagcaaggtggacatcaactgtgaggacatggaggacgggacatgcaaagtcacctactgccccaccgagcccggcacctacatcatcaacatcaagtttgctgacaagcacgtgcctggaagccccttcactgtgaaggtgaccggcgagggccgcatgaaggagagcatcacccggcggagacaggcaccttccatcgccaccatcggcagcacctgtgacctcaacctcaagatcccaggaaactggttccagatggtgtctgcccaggagcgcctgacacgcaccttcacacgcagcagccacacctacacccgcacggagcgcacggagatcagcaagacgcggggcggggagacaaagcccgaggtgcgggtggaggagtccacccaggtcggcggggaccccttccctgctgtgtttggggacttcctgggccgggagcgcctgggatccttcggcagcatcacccggcagcaggagggtgaggccagctctcaggacatgactgcacaggtgaccagcccatcgggcaaggtggaagccgcagagatcgtcgagggcgaggacagcgcctacagcgtccgctttgtgccccaggaaatggggccccatacggtcgctgtcaagtaccgtggccagcacgtgcccggcagcccctttcagttcactgtggggccgctgggtgaaggtggtgcccacaaggtgcgggccggacgagcagggctggagcgaggtgtggccggcgtgccagccgagttcagcatctggacccgggaggctggcgctgggggcctgtccattgctgtggagggtcctagcaaagcggagattgcatttgaggatcgcaaagatggctcctgcggcgtctcctatgtcgtccaggaaccaggtgactatgaggtctccatcaagttcaatgatgagcacatcccagacagcccctttgtggtgcctgtggcctccctctcggatgacgctcgccgtctcactgtcaccagcctccaggagacggggctcaaggtgaaccagccagcgtcctttgccgtgcagctgaacggtgcccggggcgtgattgatgcccgggtgcacacaccctcgggggctgtggaggagtgctacgtctctgagctggacagtgacaagcacaccatccgcttcatcccccacgagaatggcgtccactccatcgatgtcaagttcaacggtgcccacatccctggaagtcccttcaagatccgcgttggggagcagagccaggctggggacccaggcttggtgtcagcctacggtcctgggctcgagggaggcactaccggtgtgtcatcagagttcatcgtgaacaccctgaatgccggctcgggggccttgtctgtcaccattgatggcccctccaaggtgcagctggactgtcgggagtgtcctgagggccatgtggtcacttatactcccatggcccctggcaactacctcattgccatcaagtacggtggcccccagcacatcgtgggcagccccttcaaggccaaggtcactggtccgaggctgtccggaggccacagccttcacgaaacatccacggttctggtggagactgtgaccaagtcctcctcaagccggggctccagctacagctccatccccaagttctcctcagatgccagcaaggtggtgactcggggccctgggctgtcccaggccttcgtgggccagaagaactccttcaccgtggactgcagcaaagcaggcaccaacatgatgatggtgggcgtgcacggccccaagaccccctgtgaggaggtgtacgtgaagcacatggggaaccgggtgtacaatgtcacctacactgtcaaggagaaaggggactacatcctcattgtcaagtggggtgacgaaagtgtccctggaagccccttcaaagtcaaggtcccttgaatcccaaaagtgcctccccagcctcagcccccacctccagccacacacacattacacacacacacacacacacacaaatgtgccacacccagacacgcacagaatcagacactacaaacacctgccttgggggtgaagtgaaggcccagcctccccaccccaccgcgccccaggggttggaggaccttgtctgtgtcagacagtgtccctccctggaatgtgacatgaggccgactggggccaggctcaggggcagaggctgggacacaaggggctggcgagggctgcgaggccagggaagccctgagtttctggcggggctgagcagtgggggagcattgtgttgtgggtgtctgtgtgtgaggtcaccctcaaactgcaccgccggccagataccctcctgaccccgaggacttggtctggtctctctggtggctacaaccccagagttttaaggacttggaaaggaagcacaatcagagaagaaaacagcccccaaccagcaggagcggcctggcacatggaccggcctgagcgatgtgcactccacccaagccaggctcccagggggcctgatttctctctcactgtctctttttttaaaatggttgcacggctctgccccatggggggccttttttacacactgcgaggcccagctttctaggggacttttgcacatgtcatgcagctcagctgggagctgcttaggtggaaaactccaaataaagtgcgcctgtcgcc

SEQ ID NO: 1285 - DNA, 8976 bp, Homo sapiens
agcccaaaccgcggccctagccccggccgcacccccagcccgcgccagcatgatgaacaacagcggctactcagacgccggcctcggcctgggcgatgagacagacgagatgccgtccacggagaaggacctggcggaggacgcgccgtggaagaagatccagcagaacacattcacgcgctggtgcaatgagcacctcaagtgcgtgggcaagcgcctgaccgacctgcagcgcgacctcagcgacgggctccggctcatcgcgctgctcgaggtgctcagccagaagcgcatgtaccgcaagttccatccgcgccccaacttccgccaaatgaagctggagaacgtgtccgtggccctcgagttcctcgagcgcgagcacatcaagctcgtgtccatagacagcaaggccatcgtggatgggaacctgaagctgatcctgggcctgatctggacgctgatcctgcactactccatctccatgcccatgtgggaggatgaagatgatgaggatgcccgcaaacagacgcccaagcagcggctgcttggctggatccagaacaaggtgccccagctgcccatcaccaacttcaaccgtgactggcaggacggcaaagctctgggcgccctggtggacaactgcgcccccggtctctgccccgactgggaggcctgggaccccaaccagcccgtggagaacgcccgggaggccatgcagcaggccgacgactggcttggggtgccccaggtcattgcccctgaggagattgtggaccccaacgtggatgagcattctgttatgacctacctgtcccagttccccaaggccaagctcaaacctggtgcccctgttcgatccaagcagctgaaccccaagaaagccatcgcctatgggcctggcatcgagccacagggcaacaccgtgctgcagcctgcccacttcaccgtgcagacggtggacgcgggcgtgggcgaggtgctggtctacatcgaggaccctgaaggccacaccgaggaggctaaggtggttcccaacaatgacaaggatcgcacctatgctgtctcctatgtgcccaaggtcgctgggttacacaaggtgaccgtgctctttgctggccagaacattgaacgcagtccctttgaggtgaacgtgggcatggccctgggagatgccaacaaggtgtcagcccgtggccctggcctggaacctgtgggcaatgtggccaacaaacccacctactttgacatctacactgcgggggccggcactggcgatgttgctgtggtgatcgtggacccacagggccggcgggacacagtggaggtggccctggaggacaagggtgacagcacgttccgctgcacatacagacctgccatggaggggccacataccgtgcatgtggcctttgcgggtgcccccatcacccgcagtcccttccctgtccatgtgtcggaagcctgtaaccccaacgcctgccgcgcctctgggcgaggcctgcagcccaagggtgttcgcgtgaaagaggtggctgacttcaaggtgtttaccaagggtgccggcagcggggagctcaaggtcacggtcaaggggccaaagggcacagaggagccagtgaaggtgcgggaggctggggatggtgtgttcgagtgcgagtactacccggtggtgcctgggaagtatgtggtgaccatcacgtggggcggctacgccatccctcgcagcccctttgaggtacaggtgagcccagaggcaggagtgcaaaaggtccgggcctggggtcctggtttggagactggccaggtgggcaagtcagccgattttgtggtggaagccattggcaccgaggtggggacactgggcttctccatcgaggggccctcacaagccaagatcgaatgtgacgacaagggggatggctcctgcgatgtgcggtactggcccacggagcctggggagtacgctgtgcacgtcatctgtgacgatgaggacatccgagactcacccttcattgcccacatcctgcccgccccacctgactgcttcccagataaggtgaaggcctttgggcctggcctggagcctaccggctgcatcgtggacaagcccgctgagttcaccattgatgctcgtgcagctggcaagggagacctgaagctctatgcccaggacgccgacggctgtcccatcgacatcaaggtgatccccaacggcgacggcaccttccgctgctcctacgtgcccaccaagcccattaagcacaccatcatcatctcctggggaggcgtaaacgtgcccaagagccccttccgggtgaacgtgggcgagggcagccaccccgagcgggtaaaggtgtacggccccggagtggagaagacaggcctcaaggccaatgagcccacctacttcacggtggactgcagcgaggcggggcaaggcgacgtgagcatcggcatcaagtgcgccccaggcgtggtgggccctgcagaggctgacattgacttcgacatcatcaagaatgacaacgacaccttcaccgtcaagtacacgccaccaggggcgggccgctacaccatcatggtgctgtttgccaaccaggagatccccgccagccccttccacatcaaggtggacccatcccacgatgccagcaaagtcaaggccgagggccctgggctgaatcgcacaggtgtggaagtcgggaagcccacccacttcacggtgctgaccaagggagccggcaaggccaagctggatgtgcagtttgcagggacagccaagggcgaggttgtgcgggactttgagatcatagacaaccatgactactcctacactgtcaagtacaccgctgtccagcagggcaacatggcagtgacagtgacttatggcggggaccctgtccccaagagcccctttgtggtgaatgtggcacccccgctggacctcagcaaaatcaaagttcagggccttaatagcaaggtggctgtgggacaggaacaagcattctctgtgaacacacgaggggctggcggtcagggccaactggatgtgcggatgacttcgccctctcgccggcccatcccctgcaagctggagccaggcggtggagcggaagcccaggctgtgcgctacatgcccccggaggaggggccctacaaggtggatatcacctacgatggtcacccggtgcctggcagcccgtttgctgtggagggtgtcctgccccctgatccctccaaggtctgtgcttatggcccgggtctcaagggtggactggtaggcacccccgcgccattctccatcgacaccaagggggctggcacaggtggcctggggctgaccgtagagggcccctgcgaggccaagatcgagtgccaggacaatggtgatggctcatgtgctgtcagctacctgcccacggagcctggcgagtacaccatcaacatcctgtttgctgaggcccacatccctggctcgcccttcaaagccaccattcggcctgtgtttgacccgagcaaggtgcgggccagtggaccgggcctggagcgcggcaaggtcggtgaggcagccaccttcactgtggactgctcagaggcaggcgaggcggagctgaccattgagatcctgtcggatgccggggtcaaggccgaggtgctgatccacaacaacgcggatggcacctaccacatcacctacagccctgccttccctggcacctacaccattaccatcaagtatggcgggcatcccgtgcccaaattccccacccgtgtccatgtgcagcctgcggtcgataccagtggcgtcaaggtctcagggcctggtgttgagccacacggtgtcctgcgggaggtgaccactgagttcactgtggatgcaagatccctaacagccacaggcggcaaccacgtgacggctcgtgtgctcaacccctcgggggccaagacagacacctatgtgacagacaatggggacggcacctaccgagtgcagtacaccgcctacgaggagggcgtgcatctggtggaggtcctgtatgatgaggtcgctgtgcccaagagccccttccgagtgggcgtgaccgagggctgtgatcccacccgcgtccgagccttcgggccaggcctggagggtggcttggtcaacaaggccaaccgattcactgtggagaccaggggagcgggcaccgggggccttggcctagccatcgagggtccctcggaagccaagatgtcctgcaaggacaacaaggatggtagctgcaccgtggagtacatccccttcactcctggagactatgacgtcaacatcaccttcggggggcggcccatcccagggagcccgttccgcgtgccagtgaaggatgtggtggaccctgggaaggtgaagtgctcagggccagggctgggggctggtgtcagggcccgggttcctcagaccttcacagtggactgcagtcaagctggccgggcgcccctgcaggtggctgtgctgggccccacaggtgtggccgagcctgtggaggtgcgggacaatggagatggcacccacactgtccactacaccccagccactgacgggccctacacggtagccgtcaagtatgctgaccaggaggtgccacgcagccccttcaagatcaaggtcctcccagctcatgatgccagcaaggtgcgggccagcggcccaggcctcaacgcctctggcatccctgccagcctgcctgtggagttcaccatcgacgcacgggacgcgggcgaggggttgctcactgtccagatcttggaccccgagggtaagcccaagaaggccaacatccgggacaatggggatggcacgtacactgtgtcctacctgccggacatgagtggccggtacaccatcaccatcaagtatggcggtgatgagatcccctactcgcccttccgcatccatgctctgcccactggggatgccagcaagtgcctcgtcacagtgtccattggaggccatggcctgggtgcctgcctgggccctcgaatccagattgggcaggagacggtgatcacggtggatgccaaggcagccggtgaggggaaggtgacatgcacggtgtccacgccggatggggcagagctcgatgtggatgtggttgagaaccatgacggtacctttgacatctactacacagcgcccgagccgggcaagtacgtcatcaccatccgcttcgggggtgagcacatccccaacagccccttccacgtgctggcgtgtgaccccctgccgcacgaggaggagccctctgaagtgccacagctgcgccagccctacgctcctccccggcccggcgcccgccccacacactgggccacagaggagccagtggtgcctgtggagccaatggagtccatgctgaggcccttcaacctggtcatccccttcgcggtgcagaaaggggagctcacaggagaggtgcggatgccctcggggaagacggcacggcccaacatcaccgacaacaaggacggcaccatcacggtgaggtatgcacccactgagaaaggcctgcaccagatggggatcaagtatgacggcaaccacatccctgggagccccttacagttctatgtggatgccatcaacagccgccatgtcagtgcctatgggccaggcctgagccatggcatggtcaacaagccagccaccttcactattgtcaccaaagatgctggagaagggggtctgtcactggccgtggagggcccatccaaggcagagatcacctgtaaggacaacaaggatggcacctgcaccgtgtcctatctgccgactgcgcctggagactacagcatcatcgtgcgcttcgatgacaagcacatcccggggagccccttcacagccaagatcacaggtgatgactccatgaggacctcacagctgaatgtgggcacctccacggacgtgtcactgaagatcaccgagagtgatctgagccagctgaccgccagcatccgtgccccctcgggcaacgaggagccctgcctgctgaagcgcctgcccaaccggcacattgggatctccttcacccccaaggaggtcggggagcacgtggtgagcgtgcgcaagagtggcaagcatgtcaccaacagccccttcaagatcctggtggggccatctgagatcggggacgccagcaaggtgcgggtctggggcaaggggctttccgagggacacacattccaggtggcagagttcatcgtggacactcgcaatgcaggttatgggggcttggggctgagtattgaaggcccaagcaaggtggacatcaactgtgaggacatggaggacgggacatgcaaagtcacctactgccccaccgagcccggcacctacatcatcaacatcaagtttgctgacaagcacgtgcctggaagccccttcactgtgaaggtgaccggcgagggccgcatgaaggagagcatcacccggcggagacaggcaccttccatcgccaccatcggcagcacctgtgacctcaacctcaagatcccaggaaactggttccagatggtgtctgcccaggagcgcctgacacgcaccttcacacgcagcagccacacctacacccgcacggagcgcacggagatcagcaagacgcggggcggggagacaaagcgcgaggtgcgggtggaggagtccacccaggtcggcggggaccccttccctgctgtgtttggggacttcctgggccgggagcgcctgggatccttcggcagcatcacccggcagcaggagggtgaggccagctctcaggacatgactgcacaggtgaccagcccatcgggcaaggtggaagccgcagagatcgtcgagggcgaggacagcgcctacagcgtgcgctttgtgccccaggaaatggggccccatacggtcgctgtcaagtaccgtggccagcacgtgcccggcagcccctttcagttcactgtggggccgctgggtgaaggtggtgcccacaaggtgcgggccggaggcacagggctggagcgaggtgtggccggcgtgccagccgagttcagcatctggacccgggaggctggcgctgggggcctgtccattgctgtggagggtcctagcaaagcggagattgcatttgaggatcgcaaagatggctcctgcggcgtctcctatgtcgtccaggaaccaggtgactatgaggtctccatcaagttcaatgatgagcacatcccagacagcccctttgtggtgcctgtggcctccctctcggatgacgctcgccgtctcactgtcaccagcctccaggagacggggctcaaggtgaaccagccagcgtcctttgccgtgcagctgaacggtgcccggggcgtgattgatgcccgggtgcacacaccctcgggggctgtggaggagtgctacgtctctgagctggacagtgacaagcacaccatccgcttcatcccccacgagaatggcgtccactccatcgatgtcaagttcaacggtgcccacatccctggaagtcccttcaagatccgcgttggggagcagagccaggctggggacccaggcttggtgtcagcctacggtcctgggctcgagggaggcactaccggtgtgtcatcagagttcatcgtgaacaccctgaatgccggctcgggggccttgtctgtcaccattgatggcccctccaaggtgcagctggactgtcgggagtgtcctgagggccatgtggtcacttatactcccatggcccctggcaactacctcattgccatcaagtacggtggcccccagcacatcgtgggcagccccttcaaggccaaggtcactggtccgaggctgtccggaggccacagccttcacgaaacatccacggttctggtggagactgtgaccaagtcctcctcaagccggggctccagctacagctccatccccaagttctcctcagatgccagcaaggtggtgactcggggccctgggctgtcccaggccttcgtgggccagaagaactccttcaccgtggactgcagcaaagcaggcaccaacatgatgatggtgggcgtgcacggccccaagaccccctgtgaggaggtgtacgtgaagcacatggggaaccgggtgtacaatgtcacctacactgtcaaggagaaaggggactacatcctcattgtcaagtggggtgacgaaagtgtccctggaagccccttcaaagtcaaggtcccttgaatcccaaaagtgcctccccagcctcagcccccacctccagccacacacacattacacacacacacacacacacacaaatgtgccacacccagacacgcacagaatcagacactacaaacacctgccttgggggtgaagtgaaggcccagcctccccaccccaccgcgccccaggggttggaggaccttgtctgtgtcaggacagtgtccctccctgggaatgtgacatgagggccgactggggccaggctcaggggcagaggctgggacacaaggggctggcgagggctgcgaggccagggaagccctgagtttctggcggggctgagcagtgggggagcattgtgttgtgggtgtctgtgtgtgaggtcaccctcaaactgcaccgccggccagataccctcctgaccccgaggacttggtctggtctctctggtggctacaaccccagagttttaaggacttggaaaggaaagcacaatcagagaagaaaacagcccccgaaccagcaggagtggcctggcacatggaccggcctgagcgatgtgcactccacccaagccaggctcccagggggcctgatttctctctcactgtctctttttttaaaatggttgcacggctctgccccatggggggccttttttacacactgcgaggcccagctttctaggggacttttgcacatgtcatgcagctcagctgggagctgcttaggtggaaaactccaaataaagtgcggctgtcgca

SEQ ID NO: 1286 - DNA, 871 bp, Homo sapiens
attttcataaacaatgaatggcacgatgccgtcagcaggaaaacattccccaccgtcaatccgtccactggagaggtcatctgtcaggtagctgaaggggacaaggaagatgtggacaaggcagtgaaggccgcccgggccgccttccagctgggctcaccttggcgccgcatggacgcatcacacaggggccggctgctgaaccgcctggccgatctgatcgagcgggaccggacctacctggcggccttggagaccctggacaatggcaagccctatgtcatctcctacctggtggatttggacatgctatgatgagtttgtggagcggagcgttgcccgggccaagtctcgggtggtcgggaacccctttgatagcaagaccgagcaggggccgcaggtggatgaaactcagtttaagaagatcctcggctacatcaacacggggaagcaagagggggcgaagctgctgtgtggtgggggcattgctgctgaccgtggttacttcatccagcccactgtgtttggagatgtgcaggatggcatgaccatcgccaaggaggagatcttcgggccagtgatgcagatcctgaagttcaagaccatagaggaggttgttgggagagccaacaattccacgtacgggctggccgcagctgtcttcacaaaggatttggacaaggccaattacctgtcccaggccctccaggcgggcactgtgtgggtcaactgctatgatgtgtttggagcccagtcaccctttggtggctacaagatgtcggggagtggccgggagttgggcgagtacgggctgcaggcatacactgaagtgaaaactgtcacagtcaaagtgcctcagaagaactcataa

SEQ ID NO: 1287 - DNA, 2050 bp, Homo sapiens
gactagctctgctctcggtccgctcgctgtccgctagcccgctgcgatgttgcgcgctgccgcccgcttcgggccccgcctgggccgccgcctcttgtcagccgccgccacccaggccgtgcctgcccccaaccagcagcccgaggtcttctgcaaccagattttcataaacaatgaatggcacgatgccgtcagcaggaaaacattccccaccgtcaatccgtccactggagaggtcatctgtcaggtagctgaaggggacaaggaagatgtggacaaggcagtgaaggccgcccgggccgccttccagctgggctcaccttggcgccgcatggacgcatcacacaggggccggctgctgaaccgcctggccgatctgatcgagcgggaccggacctacctggcggccttggagaccctggacaatggcaagccctatgtcatctcctacctggtggatttggacatggtcctcaaatgtctccggtattatgccggctgggctgataagtaccacgggaaaaccatccccattgacggagacttcttcagctacacacgccatgaacctgtgggggtgtgcgggcagatcattccgtggaatttcccgctcctgatgcaagcatggaagctgggcccagccttggcaactggaaacgtggttgtgatgaaggtagctgagcagacacccctcaccgccctctatgtggccaacctgatcaaggaggctggctttccccctggtgtggtcaacattgtgcctggatttggccccacggctggggccgccattgcctcccatgaggatgtggacaaagtggcattcacaggctccactgagattggccgcgtaatccaggttgctgctgggagcagcaacctcaagagagtgaccttggagctgggggggaagagccccaacatcatcatgtcagatgccgatatggattgggccgtggaacaggcccacttcgccctgttcttcaaccagggccagtgctgctgtgccggctcccggaccttcgtgcaggaggacatctatgatgagtttgtggagcggagcgttgcccgggccaagtctcgggtggtcgggaacccctttgatagcaagaccgagcaggggccgcaggtggatgaaactcagtttaagaagatcctcggctacatcaacacggggaagcaagagggggcgaagctgctgtgtggtgggggcattgctgctgaccgtggttacttcatccagcccactgtgtttggagatgtgcaggatggcatgaccatcgccaaggaggagatcttcgggccagtgatgcagatcctgaagttcaagaccatagaggaggttgttgggagagccaacaattccacgtacgggctggccgcagctgtcttcacaaaggatttggacaaggccaattacctgtcccaggccctccaggcgggcactgtgtgggtcaactgctatgatgtgtttggagcccagtcaccctttggtggctacaagatgtcggggagtggccgggagttgggcgagtacgggctgcaggcatacactgaagtgaaaactgtcacagtcaaagtgcctcagaagaactcataagaatcatgcaagcttcctccctcagccattgatggaaagttcagcaagatcagcaacaaaaccaagaaaaatgatccttgcgtgctgaatatctgaaaagagaaatttttcctacaaaatctcttgggtcaagaaagttctagaatttgaattgataaacatggtgggttggctgagggtaagagtatatgaggaaccttttaaacgacaacaatactgctagctttcaggatgatttttaaaaaatagattcaaatgtgttatcctctctctgaaacgcttcctataactcgagtttataggggaagaaaaagctattgtttacaattatatccccattaaggcaactgctacaccctgctttgtattctgggctaagattcattaaaaactagctgctcttaaaaaaaaaaaaaaaaaaaaaaaaaaaaaaaaaaaaaaaaaaaaaaa

SEQ ID NO: 1288 - DNA, 2280 bp, Homo sapiens
cagggggcagccacgggccgggggtacctagcgccacccgcttcgcttgcatcagctgcgcgccccatcccgaggaatggtagaggcagccccgcccccggcccgcccccgcctttccattggctgccgcgcggggcggggagcggggtcggctcagtggccctgagaccctagctctgctctcggtccgctcgctgtccgctagcccgctgcgatgttgcgcgctgccgcccgcttcgggccccgcctgggccgccgcctcttgtcagccgccgccacccaggccgtgcctgcccccaaccagcagcccgaggtcttctgcaaccagtctagattgaaaatgtcaactccagacatcactgtgcttctggaaactataaagaggaagtgggagctaggacatccccccaccacgccccgcccaagagcgtttacgtgtgttatattttcataaacaatgaatggcacgatgccgtcagcaggaaaacattccccaccgtcaatccgtccactggagaggtcatctgtcaggtagctgaaggggacaaggaagatgtggacaaggcagtgaaggccgcccgggccgccttccagctgggctcaccttggcgccgcatggacgcatcacacaggggccggctgctgaaccgcctggccgatctgatcgagcgggaccggacctacctggcggccttggagaccctggacaatggcaagccctatgtcatctcctacctggtggatttggacatggtcctcaaatgtctccggtattatgccggctgggctgataagtaccacgggaaaaccatccccattgacggagacttcttcagctacacacgccatgaacctgtgggggtgtgcgggcagatcattccgtggaatttcccgctcctgatgcaagcatggaagctgggcccagccttggcaactggaaacgtggttgtgatgaaggtagctgagcagacacccctcaccgccctctatgtggccaacctgatcaaggaggctggctttccccctggtgtggtcaacattgtgcctggatttggccccacggctggggccgccattgcctcccatgaggatgtggacaaagtggcattcacaggctccactgagattggccgcgtaatccaggttgctgctgggagcagcaacctcaagagagtgaccttggagctgggggggaagagccccaacatcatcatgtcagatgccgatatggattgggccgtggaacaggcccacttcgccctgttcttcaaccagggccagtgctgctgtgccggctcccggaccttcgtgcaggaggacatctatgatgagtttgtggagcggagcgttgcccgggccaagtctcgggtggtcgggaacccctttgatagcaagaccgagcaggggccgcaggtggatgaaactcagtttaagaagatcctcggctacatcaacacggggaagcaagagggggcgaagctgctgtgtggtgggggcattgctgctgaccgtggttacttcatccagcccactgtgtttggagatgtgcaggatggcatgaccatcgccaaggaggagatcttcgggccagtgatgcagatcctgaagttcaagaccatagaggaggttgttgggagagccaacaattccacgtacgggctggccgcagctgtcttcacaaaggatttggacaaggccaattacctgtcccaggccctccaggcgggcactgtgtgggtcaactgctatgatgtgtttggagcccagtcaccctttggtggctacaagatgtcggggagtggccgggagttgggcgagtacgggctgcaggcatacactgaagtcacagtcaaagtgcctcagaagaactcataagaatcatgcaagcttcctccctcagccattgatggaaagttcagcaagatcagcaacaaaaccaagaaaaatgatccttgcgtgctgaatatctgaaaagagaaatttttcctacaaaatctcttgggtcaagaaagttctagaatttgaattgataaacatggtgggttggctgagggtaagagtatatgaggaaccttttaaacgacaacaatactgctagctttcaggatgatttttaaaaaatagattcaaatgtgttatcctctctctgaaacgcttcctataactcgagtttataggggaagaaaaagctattgtttacaattatatcaccattaaggcaactgctacaccctgctttgtattctgggctaagattcattaaaaactagctgctcttaa

SEQ ID NO: 1289 - DNA, 2173 bp, Homo sapiens
cagggggcagccacgggccgggggtacctagcgccacccgcttcgcttgcatcagctgcgcgccccatcccgaggaatggtagaggcagccccgcccccggcccgcccccgcctttccattggctgccgcgcggggcggggagcggggtcggctcagtggccctgagaccctagctctgctctcggtccgctcgctgtccgctagcccgctgcgatgttgcgcgctgccgcccgcttcgggccccgcctgggccgccgcctcttgtcagccgccgccacccaggccgtgcctgcccccaaccagcagcccgaggtcttctgcaaccagattttcataaacaatgaatggcacgatgccgtcagcaggaaaacattccccaccgtcaatccgtccactggagaggtcatctgtcaggtagctgaaggggacaaggaagatgtggacaaggcagtgaaggccgcccgggccgccttccagctgggctcaccttggcgccgcatggacgcatcacacaggggccggctgctgaaccgcctggccgatctgatcgagcgggaccggacctacctggcggccttggagaccctggacaatggcaagccctatgtcatctcctacctggtggatttggacatggtcctcaaatgtctccggtattatgccggctgggctgataagtaccacgggaaaaccatccccattgacggagacttcttcagctacacacgccatgaacctgtgggggtgtgcgggcagatcattccgtggaatttcccgctcctgatgcaagcatggaagctgggcccagccttggcaactggaaacgtggttgtgatgaaggtagctgagcagacacccctcaccgccctctatgtggccaacctgatcaaggaggctggctttccccctggtgtggtcaacattgtgcctggatttggccccacggctggggccgccattgcctcccatgaggatgtggacaaagtggcattcacaggctccactgagattggccgcgtaatccaggttgctgctgggagcagcaacctcaagagagtgaccttggagctgggggggaagagccccaacatcatcatgtcagatgccgatatggattgggccgtggaacaggcccacttcgccctgttcttcaaccagggccagtgctgctgtgccggctcccggaccttcgtgcaggaggacatctatgatgagtttgtggagcggagcgttgcccgggccaagtctcgggtggtcgggaacccctttgatagcaagaccgagcaggggccgcaggtggatgaaactcagtttaagaagatcctcggctacatcaacacggggaagcaagagggggcgaagctgctgtgtggtgggggcattgctgctgaccgtggttacttcatccagcccactgtgtttggagatgtgcaggatggcatgaccatcgccaaggaggagatcttcgggccagtgatgcagatcctgaagttcaagaccatagaggaggttgttgggagagccaacaattccacgtacgggctggccgcagctgtcttcacaaaggatttggacaaggccaattacctgtcccaggccctccaggcgggcactgtgtgggtcaactgctatgatgtgtttggagcccagtcaccctttggtggctacaagatgtcggggagtggccgggagttgggcgagtacgggctgcaggcatacactgaagtgaaaactgtcacagtcaaagtgcctcagaagaactcataagaatcatgcaagcttcctccctcagccattgatggaaagttcagcaagatcagcaacaaaaccaagaaaaatgatccttgcgtgctgaatatctgaaaagagaaatttttcctacaaaatctcttgggtcaagaaagttctagaatttgaattgataaacatggtgggttggctgagggtaagagtatatgaggaaccttttaaacgacaacaatactgctagctttcaggatgatttttaaaaaatagattcaaatgtgttatcctctctctgaaacgcttcctataactcgagtttataggggaagaaaaagctattgtttacaattatatcaccattaaggcaactgctacaccctgctttgtattctgggctaagattcattaaaaactagctgctcttaa

SEQ ID NO: 1290 - DNA, 2506 bp, Homo sapiens
tggtggcgggcgcctgtagtcccagccacccgggaggctgaggcaggagaatggtgtgaacccgggaggcggagcttgcagtgagctgagatcgtgccactgcactccacgcactgctcttcccggtcatggaggcgccagccgccggcttgtttctgctcctgttgcttgggacttgggccccggcgccgggcagcgcctcctccgaggcaccgccgctgatcaatgaggacgtgaagcgcacagtggacctaagcagccacctggctaaggtgacggccgaggtggtcctggcgcacctgggcggcggctccacgtcccgagctacctctttcctgctggctttggagcctgagctcgaggcccggctggcgcacctgggcgtgcaggtaaagggagaagatgaggaagagaacaatttggaagtacgtgaaaccaaaattaagggtaaaagtgggagattcttcacagtcaagctcccagttgctcttgatcctggggccaagatttcagtcattgtggaaacagtctacacccatgtgcttcatccgtatccaacccagatcacccagtcagagaaacagtttgtggtgtttgaggggaaccattatttctactctccctatccaacgaagacacaaaccatgcgtgtgaagcttgcctctcgaaatgtggagagctacaccaagctggggaaccccacgcgctctgaggacctactggattatgggcctttcagagatgtgcctgcctatagtcaggatacttttaaagtacattatgagaacaacagccctttcctgaccatcaccagcatgacccgagtcattgaagtctctcactggggtaatattgctgtggaagaaaatgtggacttaaagcacacaggagctgtgcttaaggggcctttctcacgctatgattaccagagacagccagatagtggaatatcctccatccgttcttttaagaccatccttcctgctgctgcccaggatgtttattaccgggatgagattggcaatgtttctaccagccacctccttattttggatgactctgtagagatggaaatccggcctcgcttccctctctttggcgggtggaagacccattacatcgttggctacaacctcccaagctatgagtacctctataatttgggtgaccagtatgcactgaagatgaggtttgtggaccatgtgtttgatgaacaagtgatagattctctgactgtgaagatcatcctgcctgaaggagccaagaacattgaaattgatagtccctatgaaatcagccgtgccccagatgagctgcactacacctatctggacacatttggccgccctgtgattgttgcctacaagaaaaatctggtagaacagcacattcaggacattgtggtccactacacgttcaacaaggtgctcatgctgcaggagcccctgctggtggtggcggccttctacatcctgttcttcaccgttatcatctatgttcggctggacttctccatcaccaaggatccagccgcagaagccaggatgaaggtagcctgcatcacagagcaggtcttgaccctggtcaacaagagaataggcctttaccgtcactttgacgagaccgtcaataggtacaagcaatcccgggacatctccaccctcaacagtggcaagaagagcctggagactgaacacaaggccttgaccagtgagattgcactgctgcagtccaggctgaagacagagggctctgatctgtgcgacagagtgagcgaaatgcagaagctggatgcacaggtcaaggagctggtgctgaagtcggcggtggaggctgagcgcctggtggctggcaagctcaagaaagacacgtacattgagaatgagaagctcatctcaggaaagcgccaggagctggtcaccaagatcgaccacatcctggatgccctgtagcccctgcccgcatcctccagggggcccagggtgcctgcactttgctgtggcaggcagattgggtggtagtgggaggttgtgcatggaggccagtgaaagctgacatctgtaaaaggccttcaaggaagagaaaccaggccctgcgtcaggcagtgtgagtttgccgtttgtccttaactttctttttttttttttttaaaaaaagaaaactttaaaaaaactcccattaaaaacaaaacatctttgtgttttgaacaaaggaattttcaatatttgattggtattctgttctgaagtctaagatatttttcagcctataaagccccctgttttatgcccttctaattctgatgtttgggtattgtgtgagtgcatgtgtttttttttttttttttaaagcgtgtgtgaacaaatggaaataaagcagggactgtgaacatttgtttttggtctgttgaagatctctcataatttaattcttaattttgggaatagtgcttttatcaagtgctttttattcattaaataatggatttgcttctcagcaggtttgc

SEQ ID NO: 1291 - DNA, 2334 bp, Homo sapiens
gggccctacccgccctggcgcactgctcttcccggtcatggaggcgccagccgccggcttgtttctgctcctgttgcttgggacttgggccccggcgccgggcagcgcctcctccgaggcaccgccgctgatcaatgaggacgtgaagcgcacagtggacctaagcagccacctggctaaggtgacggccgaggtggtcctggcgcacctgggcggcggctccacgtcccgagctacctctttcctgctggctttggagcctgagctcgaggcccggctggcgcacctgggcgtgcaggtaaagggagaagatgaggaagagaacaatttggaagtacgtgaaaccaaaattaagggtaaaagtgggagattcttcacagtcaagctcccagttgctcttgatcctggggccaagatttcagtcattgtggaaacagtctacacccatgtgcttcatccatatccaacccagatcacccagtcagagaaacagtttgtggtgtttgaggggaaccattatttctactctccctatccaacgaagacacaaaccatgcgtgtgaagcttgcctctcgaaatgtggagagctacaccaagctggggaaccccacgcgctctgaggacctactggattatgggcctttcagagatgtgcctgcctatagtcaggatacttttaaagtacattatgagaacaacagccctttcctgaccatcaccagcatgacccgagtcattgaagtctctcactggggtaatattgctgtggaagaaaatgtggacttaaagcacacaggagctgtgcttaaggggcctttctcacgctatgattaccagagacagccagatagtggaatatcctccatccgttcttttaagaccatccttcctgctgctgcccaggatgtttattaccgggatgagattggcaatgtttctaccagccacctccttattttggatgactctgtagagatggaaatccggcctcgcttccctctctttggcgggtggaagacccattacatcgttggctacaacctcccaagctatgagtacctctataatttgggtgaccagtatgcactgaagatgaggtttgtggaccatgtgtttgatgaacaagtgatagattctctgactgtgaagatcatcctgcctgaaggagccaagaacattgaaattgatagtccctatgaaatcagccgtgccccagatgagctgcactacacctatctggatacatttggccgccctgtgattgttgcctacaagaaaaatctggtagaacagcacattcaggacattgtggtccactacacgttcaacaaggtgctcatgctgcaggagcccctgctggtggtggcggccttctacatcctgttcttcaccgttatcatctatgttcggctggacttctccatcaccaaggatccagccgcagaagccaggatgaaggtagcctgcatcacagagcaggtcttgaccctggtcaacaagagaataggcctttaccgtcactttgacgagaccgtcaataggtacaagcaatcccgggacatctccaccctcaacagtggcaagaagagcctggagactgaacacaaggccttgaccagtgagattgcactgctgcagtccaggctgaagacagagggctctgatctgtgcgacagagtgagcgaaatgcagaagctggatgcacaggtcaaggagctggtgctgaagtcggcggtggaggctgagcgcctggtggctggcaagctcaagaaagacacgtacattgagaatgagaagctcatctcaggaaagcgccaggagctggtcaccaagatcgaccacatcctggatgccctgtagcccctgcccgcatcctccagggggcccagggtgcctgcactttgctgtggcaggcagattgggtggtagtgggaggttgtgcatggaggccagtgaaagctgacatctgtaaaaggccttcaaggaagagaaaccaggccctgcgtcaggcagtgtgagtttgccgtttgtccttaactttcttttttttttttttaaaaaagaaaactttaaaaaaactcccattaaaaacaaaacatctttgtgttttgaacaaaggaattttcaatatttgattggtattctgttctgaagtctaggatatttttcagcctataaagccccctgttttatgcccttctaattctgatgtttgggtattgtgtgagtgcatgtgttttttttttttttttttttaaagcgtgtgtgaacaaatggaaataaagcagggactgtgaacattaaaaaaaaaaaaaaaaaaaaaaaaaaaaaaa

SEQ ID NO: 1292 - DNA, 2275 bp, Homo sapiens
tggtggcgggcgcctgtagtcccagccacccgggaggctgaggcaggagaatggtgtgaacccgggaggcggagcttgcagtgagctgagatcgtgccactgcactccacgcactgctcttcccggtcatggaggcgccagccgccggcttgtttctgctcctgttgcttgggacttgggccccggcgccgggcagcgcctcctccgaggcaccgccgctgatcaatgaggacgtgaagcgcacagtggacctaagcagccacctggctaaggtgacggccgaggtggtcctggcgcacctgggcggcggctccacgtcccgagctacctctttcctgctggctttggagcctgagctcgaggcccggctggcgcacctgggcgtgcaggtaaagggagaagatgaggaagagaacaatttggaagtacgtgaaaccaaaattaagggtaaaagtgggagattcttcacagtcaagctcccagttgctcttgatcctggggccaagatttcagtcattgtggaaacagtctacacccatgtgcttcatccgtatccaacccagatcacccagtcagagaaacagtttgtggtgtttgaggggaaccattatttctactctccctatccaacgaagacacaaaccatgcgtgtgaagcttgcctctcgaaatgtggagagctacaccaagctggggaaccccacgcgctctgaggacctactggattatgggcctttcagagatgtgcctgcctatagtcaggatacttttaaagtacattatgagaacaacagccctttcctgaccatcaccagcatgacccgagtcattgaagtctctcactggggtaatattgctgtggaagaaaatgtggacttaaagcacacaggagctgtgcttaaggggcctttctcacgctatgattaccagagacagccagatagtggaatatcctccatccgttcttttaagaccatccttcctgctgctgcccaggatgtttattaccgggatgagattggcaatgtttctaccagccacctccttattttggatgactctgtagagatggaaatccggcctcgcttccctctctttggcgggtggaagacccattacatcgttggctacaacctcccaagctatgagtacctctataatttgggtgaccagtatgcactgaagatgaggtttgtggaccatgtgtttgatgaacaagtgatagattctctgactgtgaagatcatcctgcctgaaggagccaagaacattgaaattgatagtccctatgaaatcagccgtgccccagatgagctgcactacacctatctggacacatttggccgccctgtgattgttgcctacaagaaaaatctggtagaacagcacattcaggacattgtggtccactacacgttcaacaaggtgctcatgctgcaggagcccctgctggtggtggcggccttctacatcctgttcttcaccgttatcatctatgttcggctggacttctccatcaccaaggatccagccgcagaagccaggatgaaggtagcctgcatcacagagcaggtcttgaccctggtcaacaagagaataggcctttaccgtcactttgacgagaccgtcaataggtacaagcaatcccgggacatctccaccctcaacagtggcaagaagagcctggagactgaacacaaggccttgaccagtgagattgcactgctgcagtccaggctgaagacagagggctctgatctgtgcgacagagtgagcgaaatgcagaagctggatgcacaggtcaaggagctggtgctgaagtcggcggtggaggctgagcgcctggtggctggcaagctcaagaaagacacgtacattgagaatgagaagctcatctcaggaaagcgccaggagctggtcaccaagatcgaccacatcctggatgccctgtagcccctgcccgcatcctccagggggcccagggtgcctgcactttgctgtggcaggcagattgggtggtagtgggaggttgtgcatggaggccagtgaaagctgacatctgtaaaaggccttcaaggaagagaaaccaggccctgcgtcaggcagtgtgagtttgccgtttgtccttaactttctttaagaaaactttaaaaaaactcccattaaaaacaaaacatctttgtgttttgaacaaaggaattttcaatatttgattggtattctgttctgaagtctaagatatttttcagcctataaagccccctgttttatgccct

SEQ ID NO: 1293 - DNA, 3677 bp, Homo sapiens
cgcggcggctgttattgttcggctgggctcggtcgggcgctgtctccctcggctctgcgggtgtcagttcgtccggcttcctcacagcccctcactcccggcggctgacagcagcagcggcggcggcgggaggagcagcagcgggaggaggagccgtgtgccctggcactgagcggccgcggccatggcgtacgcctatctcttcaagtacatcataatcggcgacacaggtgttggtaaatcatgcttattgctacagtttacagacaagaggtttcagccagtgcatgaccttactattggtgtagagttcggtgctcgaatgataactattgatgggaaacagataaaacttcagatatgggatacggcagggcaagaatcctttcgttccatcacaaggtcgtattacagaggtgcagcaggagctttactagtttacgatattacacggagagatacattcaaccacttgacaacctggttagaagatgcccgccagcattccaattccaacatggtcattatgcttattggaaataaaagtgatttagaatctagaagagaagtaaaaaaagaagaaggtgaagcttttgcacgagaacatggactcatcttcatggaaacgtctgctaagactgcttccaatgtagaagaggcatttattaatacagcaaaagaaatttatgaaaaaattcaagaaggagtctttgacattaataatgaggcaaatggcattaaaattggccctcagcatgctgctaccaatgcaacacatgcaggcaatcagggaggacagcaggctgggggcggctgctgttgagtctgtttttactgtctagctgcccaacggggcctactcacttattctttcaccccctctcctcctgctcagctgagacatgaaactatttgaaatggctttatgtcacagaagactttaatccgtcaaattcttgtataactttgaataaatggttaatgttcacttaaaagacagattttggagattgtattcatatctatttgcatttgatttctaggtcaattgatgtgattatttttgttaaatgttgtcttgtgcccttaactacgaactgaattgtattaaacactacaaagtcatcttgagtattttaaatcggtttgtgtagttaggtttcccaacatctgtggttacctaatgtttaatattatagaactgtcctcagaaactttgtcaattttcacggctataaggaaacagaaggactcttttaattctgtatttatcatttactttctgtatatatagtttaataacctgcttgggtgtaatttgccaagcttgaattctttaatgcatttgcataaattctatactgtttagagcttaaagctacagaagcattgttaggaattgcttggacactgaattttaaactttttgacattgttaacaagcatgttcatcttttcttgtcactagtccaagaaaaatatgcttaatgtatattacaaaggctttgtatatgttaacctgttttaatgccaaaagtttgctttgtccacaatttccttaagacctcttcagaaagggatttgtttgccttaatgaatactgttgggaaaaaacacagtataatgagtgaaaagggcagaagcaagaaatttctacatcttagcgactccaagaagaatgagtatccacatttagatggcacattatgaggactttaatctttccttaaacacaataatgttttcttttttcttttattcacatgatttctaagtatatttttcatgcaggacagtttttcaaccttgatgtacagtgactgtgtaaaatttttctttcagtggcaacctctataatctttaaaatatggtgagcatcttgtctgttttgaaggggatatgacaataaatctatcagatgggaaatcctgttacaaagtagaaaagctttagtaatttactcagtgtggtggttttatcctttttttctttttctcccttggtctataatgaaattgttacagcagtgcaaaataaaatcctatgtataaaagtgttctttttttttattatgaccacctcttttttaatgtatttttagtccacttacagcttttacatgggtttaagcatgttttttaaaagggtcagaatggttaacactcaaccctttttaaaaattttgctaaaatgcgacaaatctcaccatactgaaattatttttgttgatggtgtaagcagtgtaagcaagtgttttctcctgaactagcacaaaagcacttatgcctgaaagaaagcataaagaagttctaactctgaaactaactactttcatttcgctcatggccttcaactttctacaggtcttccctgaagattcagcagtactctctcaaaggtttgacagtactcttgtgggaaatcaccaaatgctgtcatagttttgttttaactgtctccttgagggcagagggaagggtgagagaaaatctgttttcatgggtatttgtagtacagcctttttttctttcaagtggctgtatcaaattcactggtcttactaatcactgtctttaccagtgagtacaaaaagttaaggcaactaggacaggtactgctgtataccaagaagagaatgattctttggaaattgttatttttaagcttctgttaatttttccagaagtttagtgcgtttcttttccatactttctcccctaattcttttatttgaagaagagaacttaatggcaaataaacaacaaaccaggacatgcattttaataccctaaggaaaaatggaaccctcaaatataactcctcccacaaccaccctaatgtgcctcagtctggggcagcaggtggacttctcaatagttcttttccacattctctacaaatcacatctaccgttaaggaatatgttatgaatcctttctgttaattgagaaagcaatgttattgtctgtgatttccagtctttgctcattttattatccctgtcaaataatgtaatattggtacctgcagttgaatttgtaatattgtaattgaatttttagttgatcttcgatcagtttttatagcatctatggacatagaaaatcagtcactgaaaaaaataaacacagctttcaatgtctcactcaacatgtaacattcaaaattgtgatcttcataaagacattgttaccattcgtcttgcaaatttaagacaactgaatgaaaagccaattttttgaaagaatgtggcatataattagatatacaactgaaacaggatatacaactgcatacaatttgtttttaatgatattttaaaatagcctgttagcaggaaaatagtccctatttatctgctaatggtcaaaaagagttaggatataaatcgtaccaaaatgtttccaatcactcagaaaaactgattcatgtctggctttgcaacaccttaaacatttattctgtcatagatagtaaagccccatctcagtttatttagtcctgaggttggcagcatggggtttgactatatgagctaaaagatacacaaagagataacgctgtttcataataaacaggaattgactatacaaataggtaaaccagcatatctacctgtatttctcagagtttagatgtgtgctttatgtttacattaaaataaagcctaacgccac

SEQ ID NO: 1294 - DNA, 639 bp, Homo sapiens
atggcgtacgcctatctcttcaagtacatcataatcggcgacacaggtgttggtaaatcatgcttattgctacagtttacagacaagaggtttcagccagtgcatgaccttactattggtgtagagttcggtgctcgaatgataactattgatgggaaacagataaaacttcagatatgggatacggcagggcaagaatcctttcgttccatcacaaggtcgtattacagaggtgcagcaggagctttactagtttacgatattacacggagagatacattcaaccacttgacaacctggttagaagatgcccgccagcattccaattccaacatggtcattatgcttattggaaataaaagtgatttagaatctagaagagaagtaaaaaaagaagaaggtgaagcttttgcacgagaacatggactcatcttcatggaaacgtctgctaagactgcttccaatgtagaagaggcatttattaatacagcaaaagaaatttatgaaaaaattcaagaaggagtctttgacattaataatgaggcaaatggcattaaaattggccctcagcatgctgctaccaatgcaacacatgcaggcaatcagggaggacagcaggctgggggcggctgctgttga

SEQ ID NO: 1295 - DNA, 2309 bp, Homo sapiens
agaagaagatcggtagattgagtggctagagaggtcggaggtaagtggctatagaagtcgggcggacccggaacccagaggacgcgacaccatgacttatgcttatctcttcaagtatatcatcatcggagacacaggtgtggggaagtcatgtctcctcctgcagtttacagataagcggttccagcctgtccacgacctcacaataggtgtggagtttggagctcgtatggtcaacattgatggaaaacaaatcaaactgcaaatctgggatacggctgggcaagaatccttccgttctatcacccgttcctactacaggggagcagctggagcactgctggtgtacgacattacaaggcgtgaaaccttcaaccacctgacctcatggttagaggatgcccggcagcactctagttccaacatggttatcatgctcattgggaataagagtgacctagagtcccgcagggatgtgaagagagaagaaggagaggcctttgctagggagcatggacttatattcatggaaacttcagccaaaacagcctgcaatgttgaagaggccttcattaacacagccaaagaaatatataggaagatccagcagggtttatttgatgtccacaatgaggcaaatggcatcaagattgggccccaacagtcaatttcaacatcagtgggacccagtgcctcccagcggaactctcgtgacatagggtccaactctggctgctgctgaacatctggcttgaactttttttgtccttcctggaatagcttcagatcaataggcttaatgaaagaggtctttcttgctttggctgagagcagcctctttttaaagtgtgatgttttgcctttccacctaaagaccaggagagaatttgggcccttactgacctgtcctccttcagggacatgagcattccctatagattagggttcttcttatcctcctatacaaatttcttaaattgttaggatcaaatgctggattacaggtgtgagccaccgtgcctggcctaaataaataatttcgtaagcatatacaatccacttcccactaagaattagggtcaaagacattctatttgaacacttgcaattacctagatctagttggcctttggttgatagatcctctgcctcggaatttcattgagtttttttcttccttgcctttgggtgtctgcttgccacttcctaagaattcttgtagaaggcagtttcctctacttgcccaagagcactgagtacttctctactatcctattattagcttctatctcttagtgtaacttcaaaacttttaagagcagtgaagttggtcagggacatgtggccacttattattacctaaagaaaacatttgttccctgttcattttattttaggggccagatctaacattgtagtgtctttcaccagatagacttctactgtttcatcaaactcccttcttaactagacctagactttctactccaatcaggctaatctacttactgaatgtgacatatttattcctagttccatacctttgcacatgccctactctccactaattatacttaaaagtccaaaaattttttctttagtaacagacttaggtactgctaagcagttattaacacaatattccttagttttcatatgttggttattcatatgtctatttatatgtatatttatttttatgtatgttactatgtaaatatggtttgcagttgtttttgtgtggaatcttgtctttccgtataagttgtaagctccttgagagcaggatccatgtcattcctttatttttataaattattccccctatcattcctttacagtgcctagtgctactcattatgtgttcattgaatttgactgacatagttaaaaacttaaggtttattttagactttcaaggaaacaaaagactttagagtcctctctctgtaattctgccccactcatttgtttaccctgggttttatacagttctcttccttctcccctcccacctttccctggctttttgcctccattccatgaggcatacagtaaggctgcctgctagtaagcagtcacataagtgggtacctatccagccattctcttttcagagcatataatactatcttagccaaacttgcctttgcttcactcatcatgcagccttctgggttggttgctatatatatcttttttccttgatgtcccattctcttccacagccctgaggtcttacgaatttttctactttctttttgctgttgatgaattgtttcattattaaatatatgcatgtatcaaag

SEQ ID NO: 1296 - DNA, 3787 bp, Homo sapiens
ctccggcggcgccggcggccgcagaacttccgggtcggcgcggaggcggggcggaggcgccgcggcggctgttattgttcggctgggctcggtcgggcgctgtctccctcggctctgcgggtgtcagttcgtccggcttcctcacagcccctcactcccggcggctgacagcagcagcggcggcggcgggcggcgcctggcgtttcgaggctgagcggcaccggggttggggcgcggaggaggagcagcagcgggaggaggagccgtgtgccctggcactgagcggccgcggccatggcgtacgcctatctcttcaagtacatcataatcggcgacacaggtgttggtaaatcatgcttattgctacagtttacagacaagaggtttcagccagtgcatgaccttactattggtgtagagttcggtgctcgaatgataactattgatgggaaacagataaaacttcagatatgggatacggcagggcaagaatcctttcgttccatcacaaggtcgtattacagaggtgcagcaggagctttactagtttacgatattacacggagagatacattcaaccacttgacaacctggttagaagatgcccgccagcattccaattccaacatggtcattatgcttattggaaataaaagtgatttagaatctagaagagaagtaaaaaaagaagaaggtgaagcttttgcacgagaacatggactcatcttcatggaaacgtctgctaagactgcttccaatgtagaagaggcatttattaatacagcaaaagaaatttatgaaaaaattcaagaaggagtctttgacattaataatgaggcaaatggcattaaaattggccctcagcatgctgctaccaatgcaacacatgcaggcaatcagggaggacagcaggctgggggcggctgctgttgagtctgtttttactgtctagctgcccaacggggcctactcacttattctttcaccccctctcctcctgctcagctgagacatgaaactatttgaaatggctttatgtcacagaagactttaatccgtcaaattcttgtataactttgaataaatggttaatgttcacttaaaagacagattttggagattgtattcatatctatttgcatttgatttctaggtcaattgatgtgattatttttgttaaatgttgtcttgtgcccttaactacgaactgaattgtattaaacactacaaagtcatcttgagtattttaaatcggtttgtgtagttaggtttcccaacatctgtggttacctaatgtttaatattatagaactgtcctcagaaactttgtcaattttcacggctataaggaaacagaaggactcttttaattctgtatttatcatttactttctgtatatatagtttaataacctgcttgggtgtaatttgccaagcttgaattctttaatgcatttgcataaattctatactgtttagagcttaaagctacagaagcattgttaggaattgcttggacactgaattttaaactttttgacattgttaacaagcatgttcatcttttcttgtcactagtccaagaaaaatatgcttaatgtatattacaaaggctttgtatatgttaacctgttttaatgccaaaagtttgctttgtccacaatttccttaagacctcttcagaaagggatttgtttgccttaatgaatactgttgggaaaaaacacagtataatgagtgaaaagggcagaagcaagaaatttctacatcttagcgactccaagaagaatgagtatccacatttagatggcacattatgaggactttaatctttccttaaacacaataatgttttcttttttcttttattcacatgatttctaagtatatttttcatgcaggacagtttttcaaccttgatgtacagtgactgtgtaaaatttttctttcagtggcaacctctataatctttaaaatatggtgagcatcttgtctgttttgaaggggatatgacaataaatctatcagatgggaaatcctgttacaaagtagaaaagctttagtaatttactcagtgtggtggttttatcctttttttctttttctcccttggtctataatgaaattgttacagcagtgcaaaataaaatcctatgtataaaagtgttctttttttttattatgaccacctcttttttaatgtatttttagtccacttacagcttttacatgggtttaagcatgttttttaaaagggtcagaatggttaacactcaaccctttttaaaaattttgctaaaatgcgacaaatctcaccatactgaaattatttttgttgatggtgtaagcagtgtaagcaagtgttttctcctgaactagcacaaaagcacttatgcctgaaagaaagcataaagaagttctaactctgaaactaactactttcatttcgctcatggccttcaactttctacaggtcttccctgaagattcagcagtactctctcaaaggtttgacagtactcttgtgggaaatcaccaaatgctgtcatagttttgttttaactgtctccttgagggcagagggaagggtgagagaaaatctgttttcatgggtatttgtagtacagcctttttttctttcaagtggctgtatcaaattcactggtcttactaatcactgtctttaccagtgagtacaaaaagttaaggcaactaggacaggtactgctgtataccaagaagagaatgattctttggaaattgttatttttaagcttctgttaatttttccagaagtttagtgcgtttcttttccatactttctcccctaattcttttatttgaagaagagaacttaatggcaaataaacaacaaaccaggacatgcattttaataccctaaggaaaaatggaaccctcaaatataactcctcccacaaccaccctaatgtgcctcagtctggggcagcaggtggacttctcaatagttcttttccacattctctacaaatcacatctaccgttaaggaatatgttatgaatcctttctgttaattgagaaagcaatgttattgtctgtgatttccagtctttgctcattttattatccctgtcaaataatgtaatattggtacctgcagttgaatttgtaatattgtaattgaatttttagttgatcttcgatcagtttttatagcatctatggacatagaaaatcagtcactgaaaaaaataaacacagctttcaatgtctcactcaacatgtaacattcaaaattgtgatcttcataaagacattgttaccattcgtcttgcaaatttaagacaactgaatgaaaagccaattttttgaaagaatgtggcatataattagatatacaactgaaacaggatatacaactgcatacaatttgtttttaatgatattttaaaatagcctgttagcaggaaaatagtccctatttatctgctaatggtcaaaaagagttaggatataaatcgtaccaaaatgtttccaatcactcagaaaaactgattcatgtctggctttgcaacaccttaaacatttattctgtcatagatagtaaagccccatctcagtttatttagtcctgaggttggcagcatggggtttgactatatgagctaaaagatacacaaagagataacgctgtttcataataaacaggaattgactatacaaataggtaaaccagcatatctacctgtatttctcagagtttagatgtgtgctttatgtttacattaaaataaagcctaacgccac

SEQ ID NO: 1297 - DNA, 1482 bp, Homo sapiens
gtcggaggtaagtggctatagaagtcgggcggacccggaacccagaggacgcgacaccatgacttatgcttatctcttcaagtatatcatcatcggagacacaggtaaccctcaggtggttcgccttcaaggctcgggcgggcattcgaagctcccaaattgggtggcgggggcggggctcactttgtgggctgggcgattcgagacgggcggggcggttcggggcggccgggggcggggctcgggagccccccttctctggtccgggaagtccatactctggaaggtgttccagggctgcgtgattccgggagtgtgctttctctttcaggtgtggggaagtcatgtctcctcctgcagtttacagataagcggttccagcctgtccacgacctcacaataggtaagtgcatctacttgttccagaacagatgataaaacctgactagctaaattgctaaagtggaaagttagcagccttcagtgttcgaagtaaaaagttacccctcactactttaaactagtccaaacttatgttaatgaagtgaccaatgaaacgttgatatgtggggagtagtgtaagggagagtatataattgaaaggtaactttttagagtgtgaggtatagactcgtcatataattttttttcaaatacaatttgtatgtttatggaaaatcccacgaaagcataactgcttatttatgaactcatctgtgctttgaggtaaattaataccagccttacttttaaaaagtaaacaccaatacatggacattttttatattggtgaagaagcaaattgaggagtcatccctgccttagaattaataggcaaataaaactaaaaactttccttttaaatgaaagagtgtgttaacagttcctcaaacgcactggcgatcctggaaaatactaacctttcccacacgtttgtgataaggcatggcctgaagaggcttttaactaccccctcttcgttatctccgtaaccccagtccaaataaacaacatatatgaaactagctttcttgccatgcaaatgcagtttctaaataaacccctacatccccattcttaccatattgctacttccaagtcccacctgtatggaaacctgaagctaccactgttcctaacggatttatttagagtcaaataattgatggggttagaaaaggatttggcagtatcaactaaaaggtattttaaagggaatattgagcgaattctcactttgcgataggggctaatgatacaatgcttaacaaggcaacaatgcttaattgtgcctctggcaattattggaaatgtaaaatgtattgttaaaaaaattaggtgggcgttgtggcgtgtgcctgtaaggtacttacttgggaggctgaggcaggagaatcacttgaactcaggaggtggaggctgcagtgagctgagatcgcaccactgcactccagcctgggtgacggagcgagactccatctc

SEQ ID NO: 1298 - DNA, 2379 bp, Homo sapiens
agaagaagatcggtagattgagtggctagagaggtcggaggtaagtggctatagaagtcgggcggacccggaacccagaggacgcgacaccatgacttatgcttatctcttcaagtatatcatcatcggagacacaggtgtggggaagtcatgtctcctcctgcagtttacagataagcggttccagcctgtccacgacctcacaataggtgtggagtttggagctcgtatggtcaacattgatggaaaacaaatcaaactgcaaatctgggatacggctgggcaagaatccttccgttctatcacccgttcctactacaggggagcagctggagcactgctggtgtacgacattacaaggcgtgaaaccttcaaccacctgacctcatggttagaggatgcccggcagcactctagttccaacatggttatcatgctcattgggaataagagtgacctagagtcccgcagggatgtgaagagagaagaaggagaggcctttgctagggagcatggacttatattcatggaaacttcagccaaaacagcctgcaatgttgaagaggccttcattaacacagccaaagaaatatataggaagatccagcagggtttatttgatgtccacaatgaggcaaatggcatcaagattgggccccaacagtcaatttcaacatcagtgggacccagtgcctcccagcggaactctcgtgacatagggtccaactctggctgctgctgaacatctggcttgaactttttttgtccttcctggaatagcttcagatcaataggcttaatgaaagaggtctttcttgctttggctgagagcagcctctttttaaagtgtgatgttttgcctttccacctaaagaccaggagagaatttgggcccttactgacctgtcctccttcagggacatgagcattccctatagattagggttcttcttatcctcctatacaaatttcttaaattgttaggatcaaagttgattatcacagtagttaaaaaataatttcatggcggggcgccatggctcatgcctgtaatcccaaagtgctggattacaggtgtgagccaccgtgcctggcctaaataaataatttcgtaagcatatacaatccacttcccactaagaattagggtcaaagacattctatttgaacacttgcaattacctagatctagttggcctttggttgatagatcctctgcctcggaatttcattgagtttttttcttccttgcctttgggtgtctgcttgccacttcctaagaattcttgtagaaggcagtttcctctacttgcccaagagcactgagtacttctctactatcctattattagcttctatctcttagtgtaacttcaaaacttttaagagcagtgaagttggtcagggacatgtggccacttattattacctaaagaaaacatttgttccctgttcattttattttaggggccagatctaacattgtagtgtctttcaccagatagacttctactgtttcatcaaactcccttcttaactagacctagactttctactccaatcaggctaatctacttactgaatgtgacatatttattcctagttccatacctttgcacatgccctactctccactaattatacttaaaagtccaaaaattttttctttagtaacagacttaggtactgctaagcagttattaacacaatattccttagttttcatatgttggttattcatatgtctatttatatgtatatttatttttatgtatgttactatgtaaatatggtttgcagttgtttttgtgtggaatcttgtctttccgtataagttgtaagctccttgagagcaggatccatgtcattcctttatttttataaattattccccctatcattcctttacagtgcctagtgctactcattatgtgttcattgaatttgactgacatagttaaaaacttaaggtttattttagactttcaaggaaacaaaagactttagagtcctctctctgtaattctgccccactcatttgtttaccctgggttttatacagttctcttccttctcccctcccacctttccctggctttttgcctccattccatgaggcatacagtaaggctgcctgctagtaagcagtcacataagtgggtacctatccagccattctcttttcagagcatataatactatcttagccaaacttgcctttgcttcactcatcatgcagccttctgggttggttgctatatatatcttttttccttgatgtcccattctcttccacagccctgaggtcttacgaatttttctactttctttttgctgttgatgaattgtttcattattaaatatatgcatgtatcaaag

SEQ ID NO: 1299 - DNA, 2335 bp, Homo sapiens
gaagaagatcggtagattgagtggctagagaggtcggaggtaagtggctatagaagtcgggcggacccggaacccagaggacgcgacaccatgacttatgcttatctcttcaagtatatcatcatcggagacacaggtgtggggaagtcatgtctcctcctgcagtttacagataagcggttccagcctgtccacgacctcacaataggtgtggagtttggagctcgtatggtcaacattgatggaaaacaaatcaaactgcaaatctgggatacggctgggcaagaatccttccgttctatcacccgttcctactacaggggagcagctggagcactgctggtgtacgacattacaaggcgtgaaaccttcaaccacctgacctcatggttagaggatgcccggcagcactctagttccaacatggttatcatgctcattgggaataagagtgacctagagtcccgcagggatgtgaagagagaagaaggagaggcctttgctagggagcatggacttatattcatggaaacttcagccaaaacagcctgcaatgttgaagaggccttcattaacacagccaaagaaatatataggaagatccagcagggtttatttgatgtccacaatgaggcaaatggcatcaagattgggccccaacagtcaatttcaacatcagtgggacccagtgcctcccagcggaactctcgtgacatagggtccaactctggctgctgctgaacatctggcttgaactttttttgtccttcctggaatagcttcagatcaataggcttaatgaaagaggtctttcttgctttggctgagagcagcctctttttaaagtgtgatgttttgcctttccacctaaagaccaggagagaatttgggcccttactgacctgtcctccttcagggacatgagcattccctatagattagggttcttcttatcctcctatacaaatttcttaaattgttaggaccaaagtgctggattacaggcgtgagccaccgtgcctggcctaaataaataatttcgtaagcatatacaatccacttcccactaagaattagggtcaaagacattctgcttgaacacttgcagttacctagatctagttggcctttggttgatagatcctctgcctcagaatttcattgagtttttttcttccttgcctttgggtgtctgcttgccacttcctaagaattcttgtagaaggcagtttcctctacttgcccaagagcactgagtacttctctactatcctattattagcttctatctcttagtgtaacttcaaaacttttaagagcagtgaagttggtcagggacatgtggccacttattattacctaaagaaaacatttgttccctgttcattttattttaggggccagatctaacattgtagtgtctttcaccagatagacttctactgtttcatcaaactcccttcttaactagacctagactttctactccaatcaggctaatctacttactgaatgtgacatatttattcctagttccatacctttgcacatgccctactctccactaattatacttaaaagtccaaaaattttttctttagtaacagacttaggtactgctaagcagttattaacacaatattccttagttttcatatgttggttattcatatgtctatttatatgtatatttatttttatgtatgttactatgtaaatatggtttgcagttgtttttgtgtggaatcttgtctttccgtataagttgtaagctccttgagagcaggatccatgtcattcctttatttttataaattattccccctatcattcctttacagtgcctagtgctgctcattatgtgttcattgaatttgactgacatagttaaaaacttaaggtttattttagactttcaaggaaacaaaagactttagagtcctctctctgtaattctgccccactcatttgtttaccctgggttttatacatttctcttccttctcccctcccacctttccctggctttttgcctccattccatgaggcatacagtaaggctgcctgctagtaagcagtcacataagtgggtacctatccagccattctcttttcagagcatataatactatcttagccaaacttgcctttgcttcactcatcatgcagccttctgggttggttgctatatatatcttttttccttgatgtcccattctcttccacagccctgaggtcttacgaatttttctactttctttttgctgttgatgaattgtttcattattaaatatatgcatgtaccaaaaaaaaaaaaaaaaaaaaaaaaaaaaaa

SEQ ID NO: 1300 - DNA, 2785 bp, Homo sapiens
ggaaggacgcaacgctgccaccatggacagtagcacctggagccccaagaccaccgcggtcacccggcctgttgagacccacgagctcattcgcaatgcagccgatatctccatcatcgttatctacttcgtggtagtgatggccgtcggactgtgggctatgttttccaccaatcgtgggactgttggaggcttcttcctggcaggccgaagtatggtgtggtggccgattggagcctccctctttgctagtaacattggaagtggccactttgtggggctggccgggactggggcagcttcaggcatcgccattggaggctttgaatggaatgccctggttttggtggttgtgctgggctggctgtttgtccccatctatattaaggctggggtggtgacaatgccagagtacctgaggaagcggtttggaggccagcggatccaggtctacctttcccttctgtccctgctgctctacattttcaccaagatctcggcagacatcttctcgggggccatattcatcaatctggccttaggcctgaatctgtatttagccatctttctcttattggcaatcactgccctttacacaattacagggggcctggcggcggtgatttacacggacaccttgcagacggtgatcatgctggtggggtctttaatcctgactgggtttgcttttcacgaagtgggaggctatgacgccttcatggaaaagtacatgaaagccattccaaccatagtgtctgatggcaacaccacctttcaggaaaaatgctacactccaagggccgactccttccacatcttccgagatcccctcacgggagacctcccatggcctgggttcatctttgggatgtccatccttaccttgtggtactggtgcacagatcaggtcattgtgcagcgctgcctctcagccaagaatatgtctcacgtgaagggtggctgcatcctgtgtgggtatctaaagctgatgcccatgttcatcatggtgatgccaggaatgatcagccgcattctgtacacagaaaaaattgcctgtgtcgtcccttcagaatgtgagaaatattgcggtaccaaggttggctgtaccaacatcgcctatccaaccttagtggtggagctcatgcccaatggactgcgaggcctgatgctatcagtcatgctggcctccctcatgagctccctgacctccatcttcaacagcgccagcaccctcttcaccatggacatctacgccaaggtccgcaagagagcatctgagaaagagctcatgattgccggaaggttgtttatcctggtgctgattggcatcagcatcgcctgggtgcccattgtgcagtcagcacaaagtgggcaactcttcgattacatccagtccatcaccagttacttgggaccacccattgcggctgtcttcctgcttgctattttctggaagagagtcaatgagccaggagccttttggggactgatcctaggacttctgattgggatttcacgtatgattactgagtttgcttatggaaccgggagctgcatggagcccagcaactgtcccacgattatctgtggggtgcactacttgtactttgccattatcctcttcgccatttctttcatcaccatcgtggtcatctccctcctcaccaaacccattccggatgtgcatctctaccgtctgtgttggagcctgcgcaacagcaaagaggagcgtattgacctggatgcggaagaggagaacatccaagaaggccctaaggagaccattgaaatagaaacacaagttcctgagaagaaaaaaggaatcttcaggagagcctatgacctattttgtgggctagagcagcacggtgcacccaagatgactgaggaagaggagaaagccatgaagatgaagatgacggacacctctgagaagcctttgtggaggacagtgttgaacgtcaatggcatcatcctggtgaccgtggctgtcttttgccatgcatattttgcctgagtcctaccttttgctgtagatttaccatggctggactcttactcaccttcctttagtctcgtcctgtggtgttgaagggaaatcagccagttgtaaattttgcccaggtggataaatgtgtacatgtgtaattataggctagctggaagaaaaccattagtttgctgttaatttatgcatttgaagccagtgtgatacagccatctgtacctactggagctgcagaagggaagtccactcagtcacatccagaaaaaggcagactaagaatcagaagccatgtgattgatgtctgacgtgagtctgtctcaggtagattccgggtgtcagtgtggtttataatccttgaatattgttttagaaactttggtctccctggttcctgccacttttcctgtccgtcctcctccccattttttttttaaaagaaagctgttttcccctcatcatatccctcttgagttttgcctggactttccctctcaagtgtgtcaatcaggtaaactgaggaatgcatggaagctgaggatggagcttgatgggctccctgtcctgggtgtttgctctctgaagtggaggcctgaggaaggtagtacttccacaaaagggagggacccgggccccagcctcaagctagtgggggaggcagatagcctgaatccaggggattttctgggcttcttaaaatgtccattgtgagttccccgtgtttgggattccactcattttggcattcacagtgcctggaatgtcttagattttcagcaa

SEQ ID NO: 1301 - DNA, 2449 bp, Homo sapiens
cgctgccaccatggacagtagcacctggagccccaagaccaccgcggtcacccggcctgttgagacccacgagctcattcgcaatgcagccgatatctccatcatcgttatctacttcgtggtagtgatggccgtcggactgtgggctatgttttccaccaatcgtgggactgttggaggcttcttcctggcaggccgaagtatggtgtggtggccgattggagcctccctctttgctagtaacattggaagtggccactttgtggggctggccgggactggggcagcttcaggcatcgccattggaggctttgaatggaatgccctggttttggtggttgtgctgggctggctgtttgtccccatctatattaaggctggggtggtgacaatgccagagtacctgaggaagcggtttggaggccagcggatccaggtctacctttcccttctgtccctgctgctctacattttcaccaagatctcggcagacatcttctcgggggccatattcatcaatctggccttaggcctgaatctgtatttagccatctttctcttattggcaatcactgccctttacacaattacagggggcctggcggcggtgatttacacggacaccttgcagacggtgatcatgctggtggggtctttaatcctgactgggtttgcttttcacgaagtgggaggctatgacgccttcatggaaaagtacatgaaagccattccaaccatagtgtctgatggcaacaccacctttcaggaaaaatgctacactccaagggccgactccttccacatcttccgagatcccctcacgggagacctcccatggcctgggttcatctttgggatgtccatccttaccttgtggtactggtgcacagatcaggtcattgtgcagcgctgcctctcagccaagaatatgtctcacgtgaagggtggctgcatcctgtgtgggtatctaaagctgatgcccatgttcatcatggtgatgccaggaatgatcagccgcattctgtacacagaaaaaattgcctgtgtcgtcccttcagaatgtgagaaatattgcggtaccaaggttggctgtaccaacatcgcctatccaaccttagtggtggagctcatgcccaatggactgcgaggcctgatgctatcagtcatgctggcctccctcatgagctccctgacctccatcttcaacagcgccagcaccctcttcaccatggacatctacgccaaggtccgcaagagagcatctgagaaagagctcatgattgccggaaggttgtttatcctggtgctgattggcatcagcatcgcctgggtgcccattgtgcagtcagcacaaagtgggcaactcttcgattacatccagtccatcaccagttacttgggaccacccattgcggctgtcttcctgcttgctattttctggaagagagtcaatgagccaggagccttttggggactgatcctaggacttctgattgggatttcacgtatgattactgagtttgcttatggaaccgggagctgcatggagcccagcaactgtcccacgattatctgtggggtgcactacttgtactttgccattatcctcttcgccatttctttcatcaccatcgtggtcatctccctcctcaccaaacccattccggatgtgcatctctaccgtctgtgttggagcctgcgcaacagcaaagaggagcgtattgacctggatgcggaagaggagaacatccaagaaggccctaaggagaccattgaaatagaaacacaagttcctgagaagaaaaaaggaatcttcaggagagcctatgacctattttgtgggctagagcagcacggtgcacccaagatgactgaggaagaggagaaagccatgaagatgaagatgacggacacctctgagaagcctttgtggaggacagtgttgaacgtcaatggcatcatcctggtgaccgtggctgtcttttgccatgcatattttgcctgagtcctaccttttgctgtagatttaccatggctggactcttactcaccttcctttagtctcgtcctgtggtgttgaagggaaatcagccagttgtaaattttgcccaggtggataaatgtgtacatgtgtaattataggctagctggaagaaaaccattagtttgctgttaatttatgcatttgaagccagtgtgatacagccatctgtacctactggagccgcagaagggagtccactcagtcacatccagaaaaaggcagactaagaatcagaagccatgtgattgatgtctgacgtgagtctgtctcaggtagattccgggtgtcagtgtggtttataatccttgaatattgttttagaaactttggtctccctggttcctgccacttttcctgtccgtcctcctccccattttttttttaaaagaaagctgttttcccctc

SEQ ID NO: 1302 - DNA, 2387 bp, Homo sapiens
gctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagccgagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggccgacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaagtga

SEQ ID NO: 1303 - DNA, 2664 bp, Homo sapiens
agagccagcccggaggagctagaaccttccccgcatttctttcagcagcctgagtcagaggcgggctggcctggcgtagccgcccagcctcgcggctcatgccccgatctgcccgaaccttctcccggggtcagcgccgcgccgcgccacccggctgagtcagcccgggcgggcgagaggctctcaactgggcgggaaggtgcgggaaggtgcggaaaggttcgcgaaagttcgcggcggcgggggtcgggtgaggcgcaaaaggataaaaagcccgtggaagcggagctgagcagatccgagccgggctggctgcagagaaaccgcagggagagcctcactgctgagcgcccctcgacggcggagcggcagcagcctccgtggcctccagcatccgacaagaagcttcagccatgcaggccccacgggagctcgcggtgggcatcgacctgggcaccacctactcgtgcgtgggcgtgtttcagcagggccgcgtggagatcctggccaacgaccagggcaaccgcaccacgcccagctacgtggccttcaccgacaccgagcggctggtcggggacgcggccaagagccaggcggccctgaacccccacaacaccgtgttcgatgccaagcggctgatcgggcgcaagttcgcggacaccacggtgcagtcggacatgaagcactggcccttccgggtggtgagcgagggcggcaagcccaaggtgcgcgtatgctaccgcggggaggacaagacgttctaccccgaggagatctcgtccatggtgctgagcaagatgaaggagacggccgaggcgtacctgggccagcccgtgaagcacgcagtgatcaccgtgcccgcctatttcaatgactcgcagcgccaggccaccaaggacgcgggggccatcgcggggctcaacgtgttgcggatcatcaatgagcccacggcagctgccatcgcctatgggctggaccggcggggcgcgggagagcgcaacgtgctcatttttgacctgggtgggggcaccttcgatgtgtcggttctctccattgacgctggtgtctttgaggtgaaagccactgctggagatacccacctgggaggagaggacttcgacaaccggctcgtgaaccacttcatggaagaattccggcggaagcatgggaaggacctgagcgggaacaagcgtgccctgcgcaggctgcgcacagcctgtgagcgcgccaagcgcaccctgtcctccagcacccaggccaccctggagatagactccctgttcgagggcgtggacttctacacgtccatcactcgtgcccgctttgaggaactgtgctcagacctcttccgcagcaccctggagccggtggagaaggccctgcgggatgccaagctggacaaggcccagattcatgacgtcgtcctggtggggggctccactcgcatccccaaggtgcagaagttgctgcaggacttcttcaacggcaaggagctgaacaagagcatcaaccctgatgaggctgtggcctatggggctgctgtgcaggcggccgtgttgatgggggacaaatgtgagaaagtgcaggatctcctgctgctggatgtggctcccctgtctctggggctggagacagcaggtggggtgatgaccacgctgatccagaggaacgccactatccccaccaagcagacccagactttcaccacctactcggacaaccagcctggggtcttcatccaggtgtatgagggtgagagggccatgaccaaggacaacaacctgctggggcgttttgaactcagtggcatccctcctgccccacgtggagtcccccagatagaggtgacctttgacattgatgctaatggcatcctgagcgtgacagccactgacaggagcacaggtaaggctaacaagatcaccatcaccaatgacaagggccggctgagcaaggaggaggtggagaggatggttcatgaagccgagcagtacaaggctgaggatgaggcccagagggacagagtggctgccaaaaactcgctggaggcccatgtcttccatgtgaaaggttctttgcaagaggaaagccttagggacaagattcccgaagaggacaggcgcaaaatgcaagacaagtgtcgggaagtccttgcctggctggagcacaaccagctggcagagaaggaggagtatgagcatcagaagagggagctggagcaaatctgtcgccccatcttctccaggctctatggggggcctggtgtccctgggggcagcagttgtggcactcaagcccgccagggggaccccagcaccggccccatcattgaggaggttgattgaatggcccttcgtgataagtcagctgtgactgtcagggctatgctatgggccttctagactgtcttctatgatcctgcccttcagagatgaactttccctccaaagctagaactttcttcccaggataactgaagtcttttgactttttggggggagggcggttcatcctcttctgcttcaaataaaaagtcattaatttattaaaacttgtgtggcactttaacattgctttcacctatattttgtgtactttgttacttgcatgtatgaattttgttatgtaaaatatagttatagacctaaataaaaaaaaaaaaaa

SEQ ID NO: 1304 - DNA, 2523 bp, Homo sapiens
cagcctgaggagctgctgcgagggtccgcttcgtctttcgagagtgactcccgcggtcccaaggctttccagagcgaacctgtgcggctgcaggcaccggcgtgttgagtttccggcgttccgaaggactgagctcttgtcgcggatcccgtccgccgtttccagcccccagtctcagagcggagcccacagagcagggcaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggttctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctggcggcttcggggctcagggtcccaagggagggtctgggtcaggccctaccattgaggaggtggattaggggcctttgttctttagtatgtttgtctttgaggtggactgttgggactcaaggactttgctgctgttttcctatgtcatttctgcttcagctctttgctgcttcacttctttgtaaagttgtaacctgatggtaattagctggcttcattatttttgtagtacaaccgatatgttcattagaattctttgcatttaatgttgatactgtaagggtgtttcgttccctttaaatgaatcaacactgccaccttctgtacgagtttgtttgtttttttttttttttttttttttgcttggcgaaaacactacaaaggctgggaatgtatgtttttataatttgtttatttaaatatgaaaaataaaatgttaaactttttcttgtctgttaa

SEQ ID NO: 1305 - DNA, 2279 bp, Homo sapiens
cgggctggctgcagagaaaccgcagggagagcctcactgctgagcgcccctcgacggcggagcggcagcagcctccgtggcctccagcatccgacaagaagcttcagccatgcaggccccacgggagctcgcggtgggcatcgacctgggcaccacctactcgtgcgtgggcgtgtttcagcagggccgcgtggagatcctggccaacgaccagggcaaccgcaccacgcccagctacgtggccttcaccgacaccgagcggctggtcggggacgcggccaagagccaggcggccctgaacccccacaacaccgtgttcgatgccaagcggctgatcgggcgcaagttcgcggacaccacggtgcagtcggacatgaagcactggcccttccgggtggtgagcgagggcggcaagcccaaggtgcgcgtatgctaccgcggggaggacaagacgttctaccccgaggagatctcgtccatggtgctgagcaagatgaaggagacggccgaggcgtacctgggccagcccgtgaagcacgcagtgatcaccgtgcccgcctatttcaatgactcgcagcgccaggccaccaaggacgcgggggccatcgcggggctcaacgtgttgcggatcatcaatgagcccacggcagctgccatcgcctatgggctggaccggcggggcgcgggagagcgcaacgtgctcatttttgacctgggtgggggcaccttcgatgtgtcggttctctccattgacgctggtgtctttgaggtgaaagccactgctggagatacccacctgggaggagaggacttcgacaaccggctcgtgaaccacttcatggaagaattccggcggaagcatgggaaggacctgagcgggaacaagcgtgccctgcgcaggctgcgcacagcctgtgagcgcgccaagcgcaccctgtcctccagcacccaggccaccctggagatagactccctgttcgagggcgtggacttctacacgtccatcactcgtgcccgctttgaggaactgtgctcagacctcttccgcagcaccctggagccggtggagaaggccctgcgggatgccaagctggacaaggcccagattcatgacgtcgtcctggtggggggctccactcgcatccccaaggtgcagaagttgctgcaggacttcttcaacggcaaggagctgaacaagagcatcaaccctgatgaggctgtggcctatggggctgctgtgcaggcggccgtgttgatgggggacaaatgtgagaaagtgcaggatctcctgctgctggatgtggctcccctgtctctggggctggagacagcaggtggggtgatgaccacgctgatccagaggaacgccactatccccaccaagcagacccagactttcaccacctactcggacaaccagcctggggtcttcatccaggtgtatgagggtgagagggccatgaccaaggacaacaacctgctggggcgttttgaactcagtggcatccctcctgccccacgtggagtcccccagatagaggtgacctttgacattgatgctaatggcatcctgagcgtgacagccactgacaggagcacaggtaaggctaacaagatcaccatcaccaatgacaagggccggctgagcaaggaggaggtggagaggatggttcatgaagccgagcagtacaaggctgaggatgaggcccagagggacagagtggctgccaaaaactcgctggaggcccatgtcttccatgtgaaaggttctttgcaagaggaaagccttagggacaagattcccgaagaggacaggcgcaaaatgcaagacaagtgtcgggaagtccttgcctggctggagcacaaccagctggcagagaaggaggagtatgagcatcagaagagggagctggagcaaatctgtcgccccatcttctccaggctctatggggggcctggtgtccctgggggcagcagttgtggcactcaagcccgccagggggaccccagcaccggccccatcattgaggaggttgattgaatggcccttcgtgataagtcagctgtgactgtcagggctatgctatgggccttctagactgtcttctatgatcctgcccttcagagatgaactttccctccaaagctagaactttcttcccaggataactgaagtcttttgactttttggggggagggcggttcatcctcttctgcttcaaataaaaagtcattaatttaaaaaaaaaaaaaaaaaaaaaaaaaaaaaaaaaaaaaaa

SEQ ID NO: 1306 - DNA, 2512 bp, Homo sapiens
gcctgaggagctgctgcgagggtccgcttcgtctttcgagagtgactcccgcggtcccaaggctttccagagcgaacctgtgcggctgcaggcaccggcgtgttgagtttccggcgttccgaaggactgagctcttgtcgcggatcccgtccgccgtttccagcccccagtctcagagcggagcccacagagcagggcaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccagcaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggttctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccctaccattgaggaggtggattaggggcctttgttctttagtatgtttgtctttgaggtggactgttgggactcaaggactttgctgctgttttcctatgtcatttctgcttcagctctttgctgcttcacttctttgtaaagttaagttgtaacctgatggtaattagctggcttcattatttttgtagtacaaccgatatgttcattagaattctttgcatttaatgttgatactgtaagggtgtttcgttccctttaaatgaatcaacactgccaccttctgtacgagtttgtttttttttttttttttttttttttttgcttggcgaaaacactacaaaggctgggaatgtatgtttttataatttgtttatttaaatatgaaaaataaaatgttaaacttt

SEQ ID NO: 1307 - DNA, 2379 bp, Homo sapiens
cctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggttctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtggattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaaaaaaaaaaaaaaaaaa

SEQ ID NO: 1308 - DNA, 1278 bp, Homo sapiens
agatccgagccgggctggcggcagagaaaccgcagggagagcctcactgctgagcgcccctcgacggcggagcggcagcagcctccgtggcctccagcatccgacaagaagcttcagccatgcaggccccacgggagctcgcggtgggcatcgacctgggcaccacctactcgtgcgtgggcgtgtttcagcagggccgcgtggagatcctggccaacgaccagggcaaccgcaccacgcccagctacgtggccttcaccgacaccgagcggctggtcggggacgcggccaagagccaggcggccctgaacccccacaacaccgtgttcgatgccaagcggctgatcgggcgcaagttcgcggacaccacggtgcagtcggacatgaagcactggcccttccaggtggtgagcgagggcggcaagcccaaggtgcgcgtatgctaccgcggggaggacaagacgttctaccccgaggagatctcgtccatggtgctgagcaagatgaaggagacggccgaggcgtacctgggccagcccgtgaagcacgcagtgatcaccgtgcccacctatttcagtaactcgcagcgccaggccaccaaggacgcgggggccatcgcggggctcaaggtgctgccgatcatcaatgaggccacggcagcagccatcgcctatgggctggaccggcggggcgcgggaaagcgcaacgtgctcatttttgacctgggtgggggcaccttcgatgtgtcggttctctccattgacgccggtgtctttgaggtgaaagccactgctggagatacccacctgggaggagaggacttcgacaaccggctcgtgaaccacttcatggaagaattccggcggaagcatgggaaggacctgagcgggaacaagcgtgccctgcgcaggctgcgcacagcctgtgagcgcgccaagcgcaccccgtcctccagcacccaggccaccctggagatagactccctgttcgagggcgtggacttctacaagtccatcactcgtgcccgctttgaggaactgtgctcagacctcttccgcagcaccctggagccggtggagaaggccctgcgggatgccaagctggacaaggcccagattcatgacttcgtcctggggggagggctccactcgcatccccaaggtgcagaagttgctgcaggacttcttcaacggcaaggagctgaacaagagcatcaaccctgatgaggctgtggcctatggggctgctgtgcaggcggccgtgttgagggggacaaat

SEQ ID NO: 1309 - DNA, 5404 bp, Homo sapiens
ggagcggtccgggaggcggacccggctcctgccagggttgggtgcgccgctgaacggatggctgagggagccccgcggatcgtttaggaaagccggccagctgatcgtcgtgtgttgccacccattcatgtcaagatgactaagtttggatttttgcgattgtcctatgagaagcaggacacacttttgaagcttctcattctgtcaatggctgctgtattatccttctccactcgtctgtttgctgtcctgagatttgaaagtgttatccatgagtttgatccgtactttaattatcggactaccaggttcctggctgaggaggggttttataaattccataactggtttgatgaccgagcctggtaccctttgggacgaatcattggaggaacaatttacccaggtttaatgatcacctctgctgcaatctaccatgtactccattttttccacatcaccatcgacattcggaatgtctgtgtgttcctggcccctctcttctcctccttcaccaccatcgtcacgtaccaccttaccaaagagctcaaggatgcaggggctgggcttcttgctgctgccatgattgctgtagttcctggatatatctcccgatctgtggctggctcctatgataatgaagggattgccatcttttgcatgctactcacctactacatgtggatcaaggcagtaaagactggttccatctgttgggcagctaagtgtgcccttgcttatttctacatggtctcgtcatggggaggttatgtgttcctgatcaacttaattcctctccacgtcctcgtgctgatgctcacaggccgtttctctcaccggatctatgtggcctactgtactgtttactgcctgggcactatactttctatgcagatctcctttgtgggtttccagcctgtcctttcatcagagcacatggcagcctttggggtctttggtctctgccagatccatgcctttgtggattacctgcgcagcaagttgaatccacaacaatttgaagttcttttccggagcgtcatctctctggtaggctttgtccttctcaccgtgggagctctcctcatgctgacaggaaaaatatctccctggacggggcgtttctactcgctgctggatccctcttatgctaagaacaacatccccatcattgcttctgtgtctgagcatcagcccacaacctggtcctcatactattttgacctgcagctcctcgtcttcatgtttccagttggcctctattactgctttagcaacctgtctgatgcccggatttttatcatcatgtatggtgtgaccagcatgtacttttcagctgtaatggtgcgtctaatgctagtgttggcacctgttatgtgcattctctctggcattggagtctcccaggtgctgtccacatacatgaagaatctggacataagtcgtccagacaagaagagcaagaagcaacaggattccacctaccctattaagaatgaagtggcaagtgggatgatactggtcatggctttctttctcatcacctacacctttcattcaacctgggtgaccagtgaggcctactcttctccgtccattgtactatctgcccgtggtggggatggcagtaggatcatatttgatgacttccgagaagcatattattggcttcgtcataatactccagaggatgcgaaggtcatgtcctggtgggattatggctatcagattacagctatggcaaaccgaacaattttagtggacaataacacatggaataatacccatatttctcgagtagggcaggcaatggcgtccacagaggaaaaagcctatgagatcatgagggagctcgatgtcagctatgtgctggtcatttttggaggcctcactgggtattcctctgatgatatcaacaagtttctttggatggtccggattggagggagcacagatacaggcaaacatatcaaggagaatgactattatactccaactggggagttccgtgtggaccgtgaaggttctccagtgctgctcaactgcctcatgtacaagatgtgttactatcgctttggacaggtttacacagaagccaagcgtcctccaggctttgaccgtgtccgaaatgctgagattgggaataaagactttgagcttgatgtcctggaggaagcatataccacagaacattggctggtcaggatatacaagacgctctttgactttataaatcagcagttttgaagactcaagacaaacagtgaaattattggtttatcaatggagaggaagaaactcttccagcattacatatagagcttgatgagatggggtctccctatgttccccaggctggtcctgaactcctggcctcaagccattctcctgcctcgccttcccaaagtgctggaattacaggcaggagccactgcgcccggccagtgctggagaatgtaatggagatgatcctgcctatccctgagttccagtctagtttactgtcagagaatacttatttccatttttcctattttgttcttgagtctctttcctcagaatttacttttccacttaaatgacgtacgcagcttttaaatttgcgttgtaagatttattttggctctccccgcctgttctttgcacattaaaaatgaaaaagtttgtagaactaagctaagcagatggtcttcctgcaaaaagaccgggctgaagtaaagcattgttttggagctggttcacagaaaaaaggcaaaactggttatcctgacttcaagctccaacataaactgctcgctttctccgggaaacttgccccgccacatacacttgactgcgtggccagttctttcgaagcctctcgctcccaacacggagttcctcccatttcttcacagtcggctctcagcagctgctgctggtttctcggctccagcaccacgagtaccgcactctgaggtttacaaagcactctgcttcaccgactgtgatcctcacagtcctgtccggtggcctcacgcaggtggcggtgcagcctttcaggcccagagcggccaggagcgaagcccgcagccccgcctggaagcgcagcgcggtcggtcgcgcgcccctgaggcttggaggcctgggcttcccccagcagcgctcgagcaccgcccagtcgagcctcacaccggatgccacttcatatttgggcccagagctcaattcgcgccgatgcggtccgccgtccttaaatctcttcagccaggatctctccccgactgcaaagcagccctgggcgggagcggcaacatctccacgtcacccttttggagccgccgacattcagaggggcaggacacgggaacgcgcgctgtcttgctttacggcgcgggtgcgcgagtttgcggcagcgtgacgccctcaagttttggcgggaaaagcgctgcatttggattcctgcagtggtgggcaaaggacagtccgccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggagaattgccatgggaccaacccagtgacagctgtcaggagtattctgactggaaagaaaaaaaaacatacctcaacccttggaaaaaaatcgattctgctcctctagctctgctgcataaaatcttagttgagaatccatcagcaagaattaccattccagacatcaaaaaagatagatggtacaacaaacccctcaagaaaggggcaaaaaggccccgagtcacttcaggtggtgtgtcagagtctcccagtggattttctaagcacattcaatccaatttggacttctctccagtaaacagtgcttctagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacagaacccctggcagcggttggtcaaaagaatgacacgattctttaccaaattggatgcagacaaatcttatcaatgcctgaaagagacttgtgagaagttgggctatcaatggaagaaaagttgtatgaatcaggttactatatcaacaactgataggagaaacaataaactcattttcaaagtgaatttgttagaaatggatgataaaatattggttgacttccggctttctaagggtgatggattggagttcaagagacacttcctgaagattaaagggaagctgattgatattgtgagcagccagaaggtttggcttcctgccacatgatcggaccatcggctctggggaatcctggttgaggccttggctcctgcctgtagtcccagctacttaggaggctgagagaggaggatcgcgtgaacctggaagtttgaggctgtagtgagctatgattgcaccagtgcactccagcttggatgacagaatggagtttcactcttgtctcccaggctggagtacaatggcatgatctcagcttactgcaacctccgtctcctgggttcaagcgattctcctgcctcagccttccaagtagctgggattacaggtgcccaccaccacacctggctaggttttgtatttttagtagagatggggttttttcatgttggccaggctgatctggaactcctgacctcaagtgatccacctgccttggcctcccaaagtgctgggattttaggtgtgagccacctcgcctggcaagggattctgttcttagtccttgaaaaaataaagttctgaatcttcaa

SEQ ID NO: 1310 - DNA, 2472 bp, Homo sapiens
ctgccagggttgggtgcgccgctgaacggatggctgagggagccccgcggatcgttaggaaagccggccagctgatcgtcgtgtgttgccacccattcatgtcaagatgactaagtttggatttttgcgattgtcctatgagaagcaggacacacttttgaagcttctcattctgtcaatggctgctgtattatccttctccactcgtctgtttgctgtcctgagatttgaaagtgttatccatgagtttgatccgtactttaattatcggactaccaggttcctggctgaggaggggttttataaattccataactggtttgatgaccgagcctggtaccctttgggacgaatcattggaggaacaatttacccaggtttaatgatcacctctgctgcaatctaccatgtactccattttttccacatcaccatcgacattcggaatgtctgtgtgttcctggcccctctcttctcctccttcacctccatcgtcacgtacctccttaccaaagagctcaaggatgcaggggctgggcttcttgctgctgccatgattgctgtagttcctggatatatctcccgatctgtggctggctcctatgataatgaagggattgccatcttttgcatgctactcacctactacatgtggatcaaggcagtaaagactggttccatctgttgggcagctaagtgtgcccttgcttatttctacatggtctcgtcatggggaggttatgtgttcctgatcaacttaattcctctccacgtcctcgtgctgatgctcacaggccgtttctctcaccggatctatgtggcctactgtactgtttactgcctgggtactatactttctaggcagatctcctttgtgggtttccagcctgtcctttcatcagagcacatggcagggtttggggtctttggtctctgccagatccatgcctttgtggattacctgcgcagcaagttgaatccacaacaatttgaagttcttttccggagcgtcatctctctggtaggctttgtccttctcaccgtgggagctctcctcatgctgacaggaaaaatatctccctggacggggcgtttctactcactgctggatccctcttatgctaagaacaacatccccatcattgcttctgtgtctgagcatcagcccacaacctggtcctcatactattttgacctgcagctcctcgtcttcatgtttccagttggcctctattactgctttagcaacctgtctgatgcccggatttttatcatcatgtatggtgtgaccagcatgtacttttcagctgtaatggtgcgtctaatgctagtgttggcacctgttatgagcattctctctggcattggagtctcccaggtgctgtccacatacatgaagaatctggacataagtcgcccagacaagaagagcaagaagcaacaggattccacctaccctattaagattgaagtggcaagtgggatgatactggtcatggctttctttctcatcacctacacctttcattcaacctgggtgaccagtgaggcctactcttctccgtccattgtactatctgcccgtggtggggatggcagtaggatcatatttgatgacttccgagaagcatattattggcttcgtcataatactccagaggatgcgaaggtcatgtcctggtgggattatggctatcagattacagctatggcaaaccgaacaattttagtggacaataacacatggaataatacccatatttctcgagtagggcaggcaatggcgtccacagaggaaaaagcctatgagatcatgagggagctcgatgtcagctatgtgctggtcatttttggaggcctcactgggtattcctctgatgatatcaacaagtttctttggatggtccggattggagggagcacagatacaggcaaacatatcaaggagaatgactattatactccaactggggagttccgtgtggaccgtgaaggttctccagtgctgctcaactgcctcatgtacaagatgtgttactatcgctttggacaggtttacacagaagccaagcgtcctccaggctttgaccgtgtccgaaatgctgagattgggaataaagactttgagcttgatgtcctggaggaaggctataccacagaacattggctggtcaggatatacaaggtaaaggacctggataatcgaggcttgtcaaggacataaatgtcacgtccagctctgatatcttcgcactgagcacatcacatttaggacgttgaagattttttttttttttttttttttaatatgcagtttgtaagaacaaaactggatggcatccgaattgtctggaagttttgtcttgggcatgatgggctgggccaaatgaaatgatttttataattctaaacaggttaccaaatgaaatgtcatggctttactttggtcaattaaaggggggaattttttta

SEQ ID NO: 1311 - DNA, 3046 bp, Homo sapiens
ggagcggtccgggaggcggacccggctcctgccagggttgggtgcgccgctgaacggatggctgagggagccccgcggatcgtttaggaaagccggccagctgatcgtcgtgtgttgccacccattcatgtcaagatgactaagtttggatttttgcgattgtcctatgagaagcaggacacacttttgaagcttctcattctgtcaatggctgctgtattatccttctccactcgtctgtttgctgtcctgagatttgaaagtgttatccatgagtttgatccgtactttaattatcggactaccaggttcctggctgaggaggggttttataaattccataactggtttgatgaccgagcctggtaccctttgggacgaatcattggaggaacaatttacccaggtttaatgatcacctctgctgcaatctaccatgtactccattttttccacatcaccatcgacattcggaatgtctgtgtgttcctggcccctctcttctcctccttcaccaccatcgtcacgtaccaccttaccaaagagctcaaggatgcaggggctgggcttcttgctgctgccatgattgctgtagttcctggatatatctcccgatctgtggctggctcctatgataatgaagggattgccatcttttgcatgctactcacctactacatgtggatcaaggcagtaaagactggttccatctgttgggcagctaagtgtgcccttgcttatttctacatggtctcgtcatggggaggttatgtgttcctgatcaacttaattcctctccacgtcctcgtgctgatgctcacaggccgtttctctcaccggatctatgtggcctactgtactgtttactgcctgggcactatactttctatgcagatctcctttgtgggtttccagcctgtcctttcatcagagcacatggcagcctttggggtctttggtctctgccagatccatgcctttgtggattacctgcgcagcaagttgaatccacaacaatttgaagttcttttccggagcgtcatctctctggtaggctttgtccttctcaccgtgggagctctcctcatgctgacaggaaaaatatctccctggacggggcgtttctactcgctgctggatccctcttatgctaagaacaacatccccatcattgcttctgtgtctgagcatcagcccacaacctggtcctcatactattttgacctgcagctcctcgtcttcatgtttccagttggcctctattactgctttagcaacctgtctgatgcccggatttttatcatcatgtatggtgtgaccagcatgtacttttcagctgtaatggtgcgtctaatgctagtgttggcacctgttatgtgcattctctctggcattggagtctcccaggtgctgtccacatacatgaagaatctggacataagtcgtccagacaagaagagcaagaagcaacaggattccacctaccctattaagaatgaagtggcaagtgggatgatactggtcatggctttctttctcatcacctacacctttcattcaacctgggtgaccagtgaggcctactcttctccgtccattgtactatctgcccgtggtggggatggcagtaggatcatatttgatgacttccgagaagcatattattggcttcgtcataatactccagaggatgcgaaggtcatgtcctggtgggattatggctatcagattacagctatggcaaaccgaacaattttagtggacaataacacatggaataatacccatatttctcgagtagggcaggcaatggcgtccacagaggaaaaagcctatgagatcatgagggagctcgatgtcagctatgtgctggtcatttttggaggcctcactgggtattcctctgatgatatcaacaagtttctttggatggtccggattggagggagcacagatacaggcaaacatatcaaggagaatgactattatactccaactggggagttccgtgtggaccgtgaaggttctccagtgctgctcaactgcctcatgtacaagatgtgttactatcgctttggacaggtttacacagaagccaagcgtcctccaggctttgaccgtgtccgaaatgctgagattgggaataaagactttgagcttgatgtcctggaggaagcatataccacagaacattggctggtcaggatatacaaggtaaaggacctggataatcgaggcttgtcaaggacataaatgtcacgtccagctctgatatgcttcgcactgagcacatcacatttaggacgttgaagatttttttttttttttttttttaatatgcagtttgtaagaacaaaactggatggcatcagaattgtctggaagttttgtcttgggcagtatgggctgggccaaatgaaatgatttttataattctaaacaggttaccaaatgaaatgtcatggctttactttggtcaattaaaggggggaatttttttaaaaaatgtgccttatttgttttgacttataactgatttgagggaggcaaaagctatgctaggctgccagaaggacataagcagaccttgtccattctcttagctccctaaattagccaaatagagacttctttctcaaatcaggaaaactatcaaagaccaattcagatcctacatttacagacagttttgtcataaccctttgcattgcagcacctagtacaattccttggaaacagcgtggctcaataaatttttattgaatgaataaatgtgggaccagaagagtgctagaagagtgcctttctgggctactatgtctctgttctcaatgtcttttatccttagacgctctttgactttataaatcagcagttttgaagactcaagacaaacagtgaaattattggtttatcaatggagaggaagaaactcttccagcattacatatagagcttgatggtcagtaggtgtttttgaatcagcttaaatataatcatacatatcaatttgaaatggagcttttcagtactctcacttattcat

SEQ ID NO: 1312 - DNA, 5827 bp, Homo sapiens
ggagcggtccgggaggcggacccggctcctgccagggttgggtgcgccgctgaacggatggctgagggagccccgcggatcgtttaggaaagccggccagctgatcgtcgtgtgttgccacccattcatgtcaagatgactaagtttggatttttgcgattgtcctatgagaagcaggacacacttttgaagcttctcattctgtcaatggctgctgtattatccttctccactcgtctgtttgctgtcctgagatttgaaagtgttatccatgagtttgatccgtactttaattatcggactaccaggttcctggctgaggaggggttttataaattccataactggtttgatgaccgagcctggtaccctttgggacgaatcattggaggaacaatttacccaggtttaatgatcacctctgctgcaatctaccatgtactccattttttccacatcaccatcgacattcggaatgtctgtgtgttcctggcccctctcttctcctccttcaccaccatcgtcacgtaccaccttaccaaagagctcaaggatgcaggggctgggcttcttgctgctgccatgattgctgtagttcctggatatatctcccgatctgtggctggctcctatgataatgaagggattgccatcttttgcatgctactcacctactacatgtggatcaaggcagtaaagactggttccatctgttgggcagctaagtgtgcccttgcttatttctacatggtctcgtcatggggaggttatgtgttcctgatcaacttaattcctctccacgtcctcgtgctgatgctcacaggccgtttctctcaccggatctatgtggcctactgtactgtttactgcctgggcactatactttctatgcagatctcctttgtgggtttccagcctgtcctttcatcagagcacatggcagcctttggggtctttggtctctgccagatccatgcctttgtggattacctgcgcagcaagttgaatccacaacaatttgaagttcttttccggagcgtcatctctctggtaggctttgtccttctcaccgtgggagctctcctcatgctgacaggaaaaatatctccctggacggggcgtttctactcgctgctggatccctcttatgctaagaacaacatccccatcattgcttctgtgtctgagcatcagcccacaacctggtcctcatactattttgacctgcagctcctcgtcttcatgtttccagttggcctctattactgctttagcaacctgtctgatgcccggatttttatcatcatgtatggtgtgaccagcatgtacttttcagctgtaatggtgcgtctaatgctagtgttggcacctgttatgtgcattctctctggcattggagtctcccaggtgctgtccacatacatgaagaatctggacataagtcgtccagacaagaagagcaagaagcaacaggattccacctaccctattaagaatgaagtggcaagtgggatgatactggtcatggctttctttctcatcacctacacctttcattcaacctgggtgaccagtgaggcctactcttctccgtccattgtactatctgcccgtggtggggatggcagtaggatcatatttgatgacttccgagaagcatattattggcttcgtcataatactccagaggatgcgaaggtcatgtcctggtgggattatggctatcagattacagctatggcaaaccgaacaattttagtggacaataacacatggaataatacccatatttctcgagtagggcaggcaatggcgtccacagaggaaaaagcctatgagatcatgagggagctcgatgtcagctatgtgctggtcatttttggaggcctcactgggtattcctctgatgatatcaacaagtttctttggatggtccggattggagggagcacagatacaggcaaacatatcaaggagaatgactattatactccaactggggagttccgtgtggaccgtgaaggttctccagtgctgctcaactgcctcatgtacaagatgtgttactatcgctttggacaggtttacacagaagccaagcgtcctccaggctttgaccgtgtccgaaatgctgagattgggaataaagactttgagcttgatgtcctggaggaagcatataccacagaacattggctggtcaggatatacaagacgctctttgactttataaatcagcagttttgaagactcaagacaaacagtgaaattattggtttatcaatggagaggaagaaactcttccagcattacatatagagcttgatgagatggggtctccctatgttccccaggctggtcctgaactcctggcctcaagccattctcctgcctcgccttcccaaagtgctggaattacaggcaggagccactgcgcccggccagtgctggagaatgtaatggagatgatcctgcctatccctgagttccagtctagtttactgtcagagaatacttatttccatttttcctattttgttcttgagtctctttcctcagaatttacttttccacttaaatgacgtacgcagcttttaaatttgcgttgtaagatttattttggctctccccgcctgttctttgcacattaaaaatgaaaaagtttgtagaactaagctaagcagatggtcttcctgcaaaaagaccgggctgaagtaaagcattgttttggagctggttcacagaaaaaaggcaaaactggttatcctgacttcaagctccaacataaactgctcgctttctccgggaaacttgccccgccacatacacttgactgcgtggccagttctttcgaagcctctcgctcccaacacggagttcctcccatttcttcacagtcggctctcagcagctgctgctggtttctcggctccagcaccacgagtaccgcactctgaggtttacaaagcactctgcttcaccgactgtgatcctcacagtcctgtccggtggcctcacgcaggtggcggtgcagcctttcaggcccagagcggccaggagcgaagcccgcagccccgcctggaagcgcagcgcggtcggtcgcgcgcccctgaggcttggaggcctgggcttcccccagcagcgctcgagcaccgcccagtcgagcctcacaccggatgccacttcatatttgggcccagagctcaattcgcgccgatgcggtccgccgtccttaaatctcttcagccaggatctctccccgactgcaaagcagccctgggcgggagcggcaacatctccacgtcacccttttggagccgccgacattcagaggggcaggacacgggaacgcgcgctgtcttgctttacggcgcgggtgcgcgagtttgcggcagcgtgacgccctcaagttttggcgggaaaagcgctgcatttggattcctgcagtggtgggcaaaggacagtccgccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggagaattgccatgggaccaacccagtgacagctgtcaggagtattctgactggaaagaaaaaaaaacatacctcaacccttggaaaaaaatcgattctgctcctctagctctgctgcataaaatcttagttgagaatccatcagcaagaattaccattccagacatcaaaaaagatagatggtacaacaaacccctcaagaaaggggcaaaaaggccccgagtcacttcaggtggtgtgtcagagtctcccagtggattttctaagcacattcaatccaatttggacttctctccagtaaacagtgcttctagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacagaacccctggcagcggttggtcaaaagaatgacacgattctttaccaaattggatgcagacaaatcttatcaatgcctgaaagagacttgtgagaagttgggctatcaatggaagaaaagttgtatgaatcaggttactatatcaacaactgataggagaaacaataaactcattttcaaagtgaatttgttagaaatggatgataaaatattggttgacttccggctttctaagggtgatggattggagttcaagagacacttcctgaagattaaagggaagctgattgatattgtgagcagccagaaggtttggcttcctgccacatgatcggaccatcggctctggggaatcctggtgaatatagtgctgctatgttgacattattcttcctagagaagattatcctgtcctgcaaactgcaaatagtagttcctgaagtgttcacttccctgtttatccaaacatcttccaatttattttgtttgttcggcatacaaataatacctatatcttaattgtaagcaaaactttggggaaaggatgaatagaattcatttgattatttcttcatgtgtgtttagtatctgaatttgaaactcatctggtggaaaccaagtttcaggggacatgagttttccagcttttatacacacgtatctcatttttatcaaaacattttgtttaattcaaaaagtacatattccatgttgatttaattctaagatgaaccaataaagacataattcttgtgacttttggacagtagatttatcagtctgtgaagcgaagccagcttcaaaacatatccccaagatttgtacttatattttcaaaagggcctggccagttatataaacctgtttttgaattataatgattaattaaaattgcaagtaggtgttttttccagtgtagttagtaaaatacttgtattttacagtgttgcataaactctagtgcttaactaactttactctaaaaattactgttgaacatcttaaatatttttctatattttctactttcatagccatattttaaccttttcaacttactggtgaccaagcttttaggtgataaagaataaaagagggaagggaagagtaaggaagctataagaaaaatagatctgattctttgttcctttacctgttagacttacaaaaagtttgtttttctaataaaatttgtatcaactttggggcatattaggttgaggccttggctcctgcctg

SEQ ID NO: 1313 - DNA, 1305 bp, Homo sapiens
accagggcacttccggcggcgctctccgcgccttatcgccaaagctgcggctctggacgcccagccgcggcgtatcccgatcacttccgggtagtgctccacgggcacgagccgcgattgggctaccgtagatggggtacttccggtgtgcaggtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggtggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcccctctccgcacagcgtggagacggggcagggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgctaaaagtggcatttttcctatgtgcagtcactcctctcatttctaaaatagggacgtggccaggcacggtggctcatgcctgtaatcccagcactttgggaggccgaggcaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaataaataaataaaaataaagcgagatgttgccctc

SEQ ID NO: 1314 - DNA, 1668 bp, Homo sapiens
ccgcgccttatcgccaaagctgcggctctggacgcccagccgcggcgtatcccgatcacttccgggtagtgctccacgggcacgagccgcgattgggctaccgtagatggggtacttccggtgtgcaggtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggcggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggtggcaaatacagtgttcagttcaagttgcccgacgtgtatggtgtattccagtttaaagtggattacaaccggctaggctacacacacctgtactcttccactcaggtatccgtgcggccactccagcacacgcagtatgagcgcttcatcccctcggcctacccctactacgccagcgccttccccatgatgctggggctcttcatcttcagcatcgtcttcttgcacatgaaggagaaggagaagtccgactgaggggctagagccctctccgcacagcgtggagacggggcaaggaggggggttattaggattggtggttttgttttgctttgtttaaagccgtgggaaaatggcacaactttacctctgtgggagatgcaacactgagagccaaggggtgggagttgggataatttttatataaaagaagtttttccactttg

SEQ ID NO: 1315 - DNA, 3295 bp, Homo sapiens
accagggcacttccggcggcgctctccgcgccttatcgccaaagctgcggctctggacgcccagccgcggcgtatcccgatcacttccgggtagtgctccacgggcacgagccgcgattgggctaccgtagatggggtacttccggtgtgcaggtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggtggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggtggcaaatacagtgttcagttcaagttgcccgacgtgtatggtgtattccagtttaaagtggattacaaccggctaggctacacacacctgtactcttccactcaggtatccgtgcggccactccagcacacgcagtatgagcgcttcatcccctcggcctacccctactacgccagcgccttctccatgatgctggggctcttcatcttcagcatcgtcttcttgcacatgaaggagaaggagaagtccgactgaggggctagagccctctccgcacagcgtggagacggggcagggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgctaaaagtggcatttttcctatgtgcagtcactcctctcatttctaaaatagggacgtggccaggcacggtggctcatgcctgtaatcccagcactttgggaggccgaggcaggcggctcacgaggtcaggagatcgagactatcctggtaacacggtaaaaccctgtctctactaaaagtacaaaaaattagctgggcgtggtggtgggcacctgtagtcccagctactcgggaggctgaggcaggagaaaggcatgaatccaggaggcagagcttgcagtgagctgagatcacgccattgcactccagcctgggcaacagtgttaagactctgtctcaaatataaataaataaataaataaataaaaataaagcgagatgttgccctcaaacttcacctggccccggtcctggtttgctaatggctgtgggtgggggttactgtgggtgatgactgactggatacaaaatcctaagtaagtggcttcatgaaattttgcctaggactggactgtctttcttttaactgtgaaatgatgatggttctccctaacgtctcctcaaaggatacaagaaagttgttgttgctagtagaccgaggggtgggaattactgaaatggaaaatctagatgacagtgctggggaagagaaaactagaacagctcagttgaagacaacctttactgcatgttgacgctgatttaggcaatagcttcctaaaaatcatgtataaagttagttagttagacatgaaatctcttccccaatgttgatacctgcccacaaaatattctcaccttcagagtataagaatcattcttaaagccaaatattcagttcaaggcacatacgtcatctgcagttgtaaatttgcatttaatatttcacaattcctgtaagagaggctagtcaggagggaaaccctcaagtttaaatccccacacttacttacttactgctcatccgtcactttcgctaagtgagattaataattcagtagctggtccagaacgcacagcttgggaacgcagaggcccaggcctcatgtaatttcccactcccgtaactgaacgtgctgacccatgttgatgtctgccttcatccaggtggcaaatcagacatgctacgctgcccccttcaaacgagttcctcgtgttaggggcaaaggtcacagccaaactctgccactgacagccagtgccttggcctggatcctctctgtggatgcaggcctacccctcctcagtccagcctcatctactagaccagcttggccattcacttttcagatgtctgtgagcacaggactgcagactgaactctcactcaagttcttccatttgccaagcccgaggccttttccggctaaccagccctctctgcgctgtcttgtctcctgactcccaccctcaccattcacagaccatcacgacacagaggatgccaagttcttttagtaattcaccagctccatgcagggacatcacagggctgccctccatgagcagaggaggagggctgcctggcagagcgtttcacactccaggttagccagaaagagcatcttcatttttgtttccacacaacacttctct

SEQ ID NO: 1316 - DNA, 2101 bp, Homo sapiens
accagggcacttccggcggcgctctccgcgccttatcgccaaagctgcggctctggacgcccagccgcggcgtatcccgatcacttccgggtagtgctccacgggcacgagccgcgattgggctaccgtagatggggtacttccggtgtgcaggtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggtggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggtggcaaatacagtgttcagttcaagttgcccgacgtgtatggtgtattccagtttaaagtggattacaaccggctaggctacacacacctgtactcttccactcaggtatccgtgcggccactccagcacacgcagtatgagcgcttcatcccctcggcctacccctactacgccagcgccttctccatgatgctggggctcttcatcttcagcatcgtcttcttgcacatgaaggagaaggagaagtccgactgaggggctagagccctctccgcacagcgtggagacggggcagggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgctaaaagtggcatttttcctatgtgcagtcactcctctcatttctaaaatagggacgtggccaggcacggtggctcatgcctgtaatcccagcactttgggaggccgaggcaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaataaataaataaaaataaagcgagatgttgccctc

SEQ ID NO: 1317 - DNA, 8541 bp, Homo sapiens
tcacaggtttccgagacactaaagcgttttgcagggaaggtgacaacagccagtgtaaaggaacggagagaaatcctcagtgaacttgggaagtgtgttgctggaaaagatcttccagagggagcagtgaaggggctctgcaaattgttctgcttgactctgcatcgatatagagatgcagcctcccgcagggccttgcaggcagccatccagcagttggctgaggcccagccagaagccactgctaagaaccttctacactctctgcagtcttctggtataggctccaaagcaggtgttcccagtaagagcagtggctctgccgccttgctggccttgacctggacctgcctcctggtgcgcattgtctttccatcgagagccaagcgacaaggagacatctggaacaaactggtggaagtgcagtgcctgctcttgctggaggtgctgggtggctcccacaagcacgccgtggatggtgctgtgaagaaactcacgaagctgtggaaagaggtgacaggactgcaggggctgaaccccgggctggtggaacagtacttgtcagccattctcagcctagagcccaaccagaactatgctggcatgctggggctgctggtgcagttctgcacgagtcacaaggagatggacgtgagcgccctactggacttttacatgaagaacatcctgatgagcaaagtcaagcctccgaagtacctgttggatagctgtgcccctctgctccgatacctgtcccactcagaatttaaggatctgatactgcccaccatacagaagtccttactgaggagtccagagaatgttattgaaactatttctagtctgctggcatcagtgacgcttgacctcagccagtatgccatggacatcgtgaaaggactggctggtcacctgaaatccaacagtccccgcctgatggatgaagctgtgctggcactgcggaacctggcacgccagtgcagtgactcttcggccatggaatccctgaccaagcacctatttgctatcctcggaggctcggaaggaaaactaactgttgtagcccagaagatgagcgtcctctcagggattgggagcgtcagtcatcacgtggtgtctggaccttccagtcaggtcctgaatgggatcgtggctgagctgttcatcccgttccttcagcaggaagttcatgaagggaccttggtacacgctgtctcagtcctggctctctggtgtaaccgattcactatggaagtgcccaagaagctcactgaatggttcaaaaaagctttcagccttaaaacctccacatctgcggtgaggcatgcctacctgcagtgcatgttggcctcttaccggggtgacacgctgttgcaggccctggacttactgcccttgctcatccagacagtggagaaggcagcctcccaaagcactcaggttcccaccatcactgaaggggttgccgcagccttgttgctcttaaagttgtcagtggctgactcacaggctgaggccaaactgagcagtttctggcagttgattgtggatgagaaaaagcaggttttcacttctgagaaattcctggtcatggcttcagaggatgccctgtgtactgtgttgcatctgacagagagacttttccttgaccacccgcatagactcactggcaacaaagttcagcagtaccaccgggctctggtggcggtgctcctgagccgcacctggcacgtccgcaggcaggctcagcagacagttcggaagctgctgtcctctcttgggggctttaagctggcgcacggactcttggaggagctgaagactgtcctcagttctcacaaggtgctgcccttagaggctttggtgactgatgctggagaggtgactgaggcaggcaaggcctacgtgcctccacgggtcctgcaggaggctctgtgtgtcatctccggtgtgccagggctcaagggtgatgtcaccgacactgaacaactggcccaggaaatgctgatcatctcccaccacccatccttaggtccgtggctgcggtggtcctccatgaatgccatgggctccctttccgtcctgtcgccggaccgggtcctcccacagctcatcagcaccatcactgcctccgtgcagaaccctgcactgcgcctggtgacgcgggaggagtttgccattatgcagacccctgctggggagctgtatgacaaatccatcattcagagtgcccagcaggacagcataaaaaaggccaacatgaagcgagagaacaaagcttattccttcaaagagcagatcatcgagctggagctgaaggaggagataaagaagaagaaaggcatcaaagaggaggtgcagctgaccagcaagcagaaggagatgctgcaggcccagctagacagggaggcgcaggtccggaggcggctgcaggagctggatggggagctggaggcggcgcttggactgctggacatcatcctggccaagaacccgtccggcctgacccagtacatccctgttttggtcgactcttttctgcccttgctgaagtctcccctggctgctcccaggatcaagaaccccttcttgtccttggctgcctgtgtcatgccctctaggctcaaggctttgggcactttggtgagccacgtgaccctgcgcctgctgaagccagagtgtgtcctggataagtcctggtgccaggaagagctgtcggtggctgtgaagagggcggtgatgctgctgcacacccacaccatcaccagcagggtgggcaagggggagccaggtgctgcgcccttgtccgcgccagccttctccttagtcttcccgtttctgaagatggtgctgacggagatgccccaccacagtgaggaggaggaggagtggatggcccagattcttcagatcctcactgtccaagcccagctgagggcctcccccaacaccccacccgggcgggtggacgagaatggcccggagttgctgcctcgcgtggccatgctgcgtcttctgacttgggtgatcgggacgggctcgcctcgcttacaggttctggcttcagacaccctgaccaccctgtgtgccagcagcagtggtgatgatggctgtgcctttgcagagcaggaggaggtggacgtgctgctctgtgccttgcagtccccgtgtgccagcgtgcgggaaaccgtgctccgggggctgatggaactccacatggtattgccagcacctgatactgatgagaagaatggcctgaaccttctgcggagactctgggtggtcaagtttgacaaggaggaggagatccggaagctggctgagaggctctggtcaatgatgggcctagacctgcagccagacctctgctccttgctgattgacgacgtgatctatcatgaggcggctgtaaggcaggcaggggccgaagccctctcccaagcagtggcacgttaccagcggcaggcggcggaggttatgggcaggctcatggagatttaccaggaaaagctctaccggccgcccccagtgctggatgctttgggacgagttatttcagaatctcctccagatcagtgggaagccaggtgtggcttggcgttggccctcaacaagctctcccagtatttggacagctctcaggtgaagccactctttcagttttttgtccctgatgccctcaatgaccgacacccagatgtccggaagtgcatgttggatgcagccctcgcaacgctcaacactcatgggaaggagaacgtcaactcgctgttgccagtattcgaggagttcctgaagaacgcgcccaatgatgccagctatgatgctgtgcgacagagtgtggtggtcctgatgggctctctggccaagcacctggacaagagtgaccccaaagtgaagcccattgttgccaagctcatcgctgccctctccaccccctcccagcaggtccaggagtccgtagccagctgcttgccacccctcgtgccagccatcaaggaggatgctggagggatgatccagaggcttatgcagcagctgctggagtcagacaagtacgcagagcgcaaaggggccgcctatggcctggcgggcctggtgaagggcctgggcatcctctcgctgaagcaacaggagatgatggcggcactgactgatgccatccaagataagaagaacttccgccggcgagagggagccctctttgccttcgagatgctctgcaccatgctggggaaactttttgagccgtatgtggttcacgtgctgccccatctgctcctgtgctttggggatggaaaccagtatgtgcgtgaggctgcagatgactgtgccaaggctgtgatgagcaacttgagtgctcacggggtgaagctggtgctcccctccttactggctgccctggaggaggaatcgtggcggaccaaagctgggtcagtggagcttcttggggcaatggcgtactgtgctcctaagcagctgtcatcctgtctacccaacattgtgcccaagcttacggaggtgctgaccgactcccatgtcaaagtccagaaggctggacagcaggcgctcaggcagatcggctccgttatcaggaacccggagatcctggccattgctccagtcctcctggatgccctgacggatccctccaggaagacccagaagtgcttgcagaccctgctggacaccaagtttgtccacttcattgatgccccatccctggccctcatcatgcccattgtccagagagccttccaggaccgttccacggacacgcggaagatggcagcccagattattggcaacatgtactccctgacagaccagaaggacttggctccgtacctgcccagcgtgacgcctggcctgaaagcatcgcttttggaccctgtgcctgaggtgcggaccgtatctgcaaaggcccttggggccatggtgaagggcatgggggagtcgtgctttgaggacttgctgccgtggctgatggagacactgacctatgagcagagctctgtggatcgctcaggcgctgcacaggggttggctgaggtcatggccggtttgggggtggagaagttggagaagttgatgccagaaatcgtggctacagccagcaaagtggacattgcaccccatgtccgagatggctacattatgatgtttaactacctgcccatcacctttggagacaagtttactccttatgtggggcccatcatcccctgtatcctcaaagctcttgctgatgagaatgagtttgtgcgtgacaccgccctgcgcgcgggccagcgggttatctccatgtacgctgagacagccatcgccctgctgctgccccagctagagcaaggcctctttgatgacctttggagaatcaggttcagctctgttcagctccttggggatctcctgtttcacatctcaggagtcactgggaagatgaccacagaaactgcctctgaggatgataactttggaactgcccagtccaacaaggcgatcatcactgccctgggggtagagcggcggaaccgggtgttggcagggctgtacatgggccgctcagacacccagctggtggtgcggcaggcgtccctgcatgtctggaagattgttgtctccaataccccccgcaccttgcgtgagatcctacccactctctttgggctcctgctgggtttcctggccagcacgtgtgcagataagagaacgattgcagcgagaacattgggagatcttgtgcggaagttaggggagaaaatcctccccgagatcatccccatccttgaggaaggcctgaggtctcagaagagcgatgagaggcagggtgtgtgcattggcctaagtgagatcatgaagtccaccagccgggatgccgtgctgtatttctctgaatccctcgtgcccacggcaaggaaggctttgtgtgacccactggaggaggtcagagaggcggcagccaagactttcgagcagctgcattccaccatcggccaccaggctctggaggacattctcccatttttactaaagcagctggatgacgaggaggtgtcagagtttgccttggatggtctgaagcaagtcatggctattaagagtcgtgtggtgctgccctaccttgtgcccaagctgacaacgccacctgtcaacacccgggtgctggctttcctttcgtcagtggctggtgatgccctcacccgtcatcttggcgtgatcctcccagcggtcatgctggccctgaaggaaaagcttgggaccccagatgagcagctggagatggccaattgtcaggctgtgatcctctccgtagaggatgacacagggcaccggatcatcatcgaggatctgctggaggccacccgcagccctgaggtgggcatgaggcaagctgctgccatcatcctcaacatctactgttcccgctcaaaggctgactacaccagccacctgcggagcctggtctcgggcctgatccgcctcttcaatgactccagccctgtggttctggaggagagctgggatgccctaaatgccatcactaagaagctggatgctggcaaccagttggcactcattgaagagctgcacaaggaaatccggctcatagggaacgagagcaaaggcgagcatgtgccaggattctgcctcccgaagaagggagtgacctccatccttccagtgttgcgggaaggagtcctgactggcagccctgagcagaaggaggaggcagccaaagccttaggcttggtaatccgcctgacctcggctgacgccctgaggccctccgtggtcagcatcactggccctctgatccgcatcctgggggacaggttcagctggaatgtgaaggcggctctgctcgagacactcagcctcttgttggctaaggttgggattgccctgaagcccttcctgccccagctgcagaccactttcaccaaagccctgcaggactccaaccggggggtgcgcctgaaggccgcagatgctctggggaagctcatttccatccacattaaggtggaccccctcttcacagagctgctcaatggcatccgcgccatggaggacccaggtgtcagggacaccatgctgcaggccctgaggtttgtgattcagggagcaggggccaaagtggatgccgtcatccggaaaaacatcgtctcactcctgctgagcatgctgggacacgatgaggacaacactcgcatctcctcagccgggtgcctaggggaactgtgtgcctttttgactgaagaggagcttagtgccgttctacagcagtgcttgctggcggacgtgtccggcattgactggatggttcggcacgggcggagcctggcactttccgtggctgtgaatgtggctcctggcagactttgtgccggcagatatagcagtgatgttcaggaaatgatcctgagcagtgccacggcggacaggatccccattgcggtgagcggggtccggggcatgggctttctcatgagacaccacatcgagacaggcggagggcagttgccggccaaactttccagcctgttcgttaagtgtctgcagaacccatccagcgacatcaggctggtggctgagaagatgatctggtgggcaaataaggacccactgcctcccctggacccccaggccatcaagcccatcctgaaggctcttcttgacaacaccaaggataagaacaccgtggtcagggcctacagcgaccaggcaattgtcaacctcctcaagatgcggcagggtgaagaggtgtttcagtccctctccaagatcctggatgtggccagtttggaggtgctgaacgaggttaaccgaaggtccctgaagaagctggccagccaggccgactccacggagcaggtggacgacaccatcctgacatgagaggcctgggccagcagcagcattgccgctccacatctttgctcaatgttttcatttttgaaaatacatttgttccaatggggagcttggaagatggcgttcccagaaagtattttaatatcaatagaccacagccaaagccttaaatcaaacccacacacaactgaaaattgcctcctccatctctcaccttttcctgtggagaagagaaggaaaagcacacgcatgcgcctcagcaaatggcagcccaggagctgtttgtccagtttagcatggctaggtctggaactataatagcagggtcagactgtgggttcctcttctcctgtgcttgagctctggtttgagagctggcgctaccaacctttttcctatatcccgagtggggcacagacggtggatctctgcccagtgtggtgtgtctggcttggcttttcaatattgtgaggtctgaatggatctgatccctgtcagatgaaaatgattcacagctctggcagttcccaagtctggggaggggtataggtttgaaaggctgtttgaaagaggaatgtttaataaaggctttgatttaatcttgatataaacagatttttaaaaatctccacccattaaacatgaagcttcctgcatcaggaa

SEQ ID NO: 1318 - DNA, 8325 bp, Homo sapiens
caggtttccgagacactaaagcgttttgcagggaaggtgacaacagccagtgtaaaggaacggagagaaatcctcagtgaacttgggaagtgtgttgctggaaaagatcttccagagggagcagtgaaggggctctgcaaattgttctgcttgactctgcatcgatatagagatgcagcctcccgcagggccttgcaggcagccatccagcagttggctgaggcccagccagaagccactgctaagaaccttctacactctctgcagtcttctggtataggctccaaagcaggtgttcccagtaagagcagtggctctgccgccttgctggccttgacctggacctgcctcctggtgcgcattgtctttccatcgagagccaagcgacaaggagacatctggaacaaactggtggaagtgcagtgcctgctcttgctggaggtgctgggtggctcccacaagcacgccgtggatggtgctgtgaagaaactcacgaagctgtggaaagaggtgacaggactgcaggggctgaaccccgggctggtggaacagtacttgtcagccattctcagcctagagcccaaccagaactatgctggcatgctggggctgctggtgcagttctgcacgagtcacaaggagatggacgtgagcgccctactggacttttacatgaagaacatcctgatgagcaaagtcaagcctccgaagtacctgttggatagctgtgcccctctgctccgatacctgtcccactcagaatttaaggatctgatactgcccaccatacagaagtccttactgaggagtccagagaatgttattgaaactatttctagtctgctggcatcagtgacgcttgacctcagccagtatgccatggacatcgtgaaaggactggctggtcacctgaaatccaacagtccccgcctgatggatgaagctgtgctggcactgcggaacctggcacgccagtgcagtgactcttcggccatggaatccctgaccaagcacctatttgctatcctcggaggctcggaaggaaaactaactgttgtagcccagaagatgagcgtcctctcagggattgggagcgtcagtcatcacgtggtgtctggaccttccagtcaggtcctgaatgggatcgtggctgagctgttcatcccgttccttcagcaggaagttcatgaagggaccttggtacacgctgtctcagtcctggctctctggtgtaaccgattcactatggaagtgcccaagaagctcactgaatggttcaaaaaagctttcagccttaaaacctccacatctgcggtgaggcatgcctacctgcagtgcatgttggcctcttaccggggtgacacgctgttgcaggccctggacttactgcccttgctcatccagacagtggagaaggcagcctcccaaagcactcaggttcccaccatcactgaaggggttgccgcagccttgttgctcttaaagttgtcagtggctgactcacaggctgaggccaaactgagcagtttctggcagttgattgtggatgagaaaaagcaggttttcacttctgagaaattcctggtcatggcttcagaggatgccctgtgtactgtgttgcatctgacagagagacttttccttgaccacccgcatagactcactggcaacaaagttcagcagtaccaccgggctctggtggcggtgctcctgagccgcacctggcacgtccgcaggcaggctcagcagacagttcggaagctgctgtcctctcttgggggctttaagctggcgcacggactcttggaggagctgaagactgtcctcagttctcacaaggtgctgcccttagaggctttggtgactgatgctggagaggtgactgaggcaggcaaggcctacgtgcctccacgggtcctgcaggaggctctgtgtgtcatctccggtgtgccagggctcaagggtgatgtcaccgacactgaacaactggcccaggaaatgctgatcatctcccaccacccatccttagttgccgtgcagtctggactttggccagcacttcttgccaggatgaagatcgatcctgaagcctttatcaccaggcacctggatcagatcattcccaggatgaccacacagagtcccctaaaccagtcctccatgaatgccatgggctccctttccgtcctgtcgccggaccgggtcctcccacagctcatcagcaccatcactgcctccgtgcagaaccctgcactgcgcctggtgacgcgggaggagtttgccattatgcagacccctgctggggagctgtatgacaaatccatcattcagagtgcccagcaggacagcataaaaaaggccaacatgaagcgagagaacaaagcttattccttcaaagagcagatcatcgagctggagctgaaggaggagataaagaagaagaaaggcatcaaagaggaggtgcagctgaccagcaagcagaaggagatgctgcaggcccagctagacagggaggcgcaggtccggaggcggctgcaggagctggatggggagctggaggcggcgcttggactgctggacatcatcctggccaagaacccgtccggcctgacccagtacatccctgttttggtcgactcttttctgcccttgctgaagtctcccctggctgctcccaggatcaagaaccccttcttgtccttggctgcctgtgtcatgccctctaggctcaaggctttgggcactttggtgagccacgtgaccctgcgcctgctgaagccagagtgtgtcctggataagtcctggtgccaggaagagctgtcggtggctgtgaagagggcggtgatgctgctgcacacccacaccatcaccagcagggtgggcaagggggagccaggtgctgcgcccttgtccgcgccagccttctccttagtcttcccgtttctgaagatggtgctgacggagatgccccaccacagtgaggaggaggaggagtggatggcccagattcttcagatcctcactgtccaagcccagctgagggcctcccccaacaccccacccgggcgggtggacgagaatggcccggagttgctgcctcgcgtggccatgctgcgtcttctgacttgggtgatcgggacgggctcgcctcgcttacaggttctggcttcagacaccctgaccaccctgtgtgccagcagcagtggtgatgatggctgtgcctttgcagagcaggaggaggtggacgtgctgctctgtgccttgcagtccccgtgtgccagcgtgcgggaaaccgtgctccgggggctgatggaactccacatggtattgccagcacctgatactgatgagaagaatggcctgaaccttctgcggagactctgggtggtcaagtttgacaaggaggaggagatccggaagctggctgagaggctctggtcaatgatgggcctagacctgcagccagacctctgctccttgctgattgacgacgtgatctatcatgaggcggctgtaaggcaggcaggggccgaagccctctcccaagcagtggcacgttaccagcggcaggcggcggaggttatgggcaggctcatggagatttaccaggaaaagctctaccggccgcccccagtgctggatgctttgggacgagttatttcagaatctcctccagatcagtgggaagccaggtgtggcttggcgttggccctcaacaagctctcccagtatttggacagctctcaggtgaagccactctttcagttttttgtccctgatgccctcaatgaccgacacccagatgtccggaagtgcatgttggatgcagccctcgcaacgctcaacactcatgggaaggagaacgtcaactcgctgttgccagtattcgaggagttcctgaagaacgcgcccaatgatgccagctatgatgctgtgcgacagagtgtggtggtcctgatgggctctctggccaagcacctggacaagagtgaccccaaagtgaagcccattgttgccaagctcatcgctgccctctccaccccctcccagcaggtccaggagtccgtagccagctgcttgccacccctcgtgccagccatcaaggaggatgctggagggatgatccagaggcttatgcagcagctgctggagtcagacaagtacgcagagcgcaaaggggccgcctatggcctggcgggcctggtgaagggcctgggcatcctctcgctgaagcaacaggagatgatggcggcactgactgatgccatccaagataagaagaacttccgccggcgagagggagccctctttgccttcgagatgctctgcaccatgctggggaaactttttgagccgtatgtggttcacgtgctgccccatctgctcctgtgctttggggatggaaaccagtatgtgcgtgaggctgcagatgactgtgccaaggctgtgatgagcaacttgagtgctcacggggtgaagctggtgctcccctccttactggctgccctggaggaggaatcgtggcggaccaaagctgggtcagtggagcttcttggggcaatggcgtactgtgctcctaagcagctgtcatcctgtctacccaacattgtgcccaagcttacggaggtgctgaccgactcccatgtcaaagtccagaaggctggacagcaggcgctcaggcagatcggctccgttatcaggaacccggagatcctggccattgctccagtcctcctggatgccctgacggatccctccaggaagacccagaagtgcttgcagaccctgctggacaccaagtttgtccacttcattgatgccccatccctggccctcatcatgcccattgtccagagagccttccaggaccgttccacggacacgcggaagatggcagcccagattattggcaacatgtactccctgacagaccagaaggacttggctccgtacctgcccagcgtgacgcctggcctgaaagcatcgcttttggaccctgtgcctgaggtgcggaccgtatctgcaaaggcccttggggccatggtgaagggcatgggggagtcgtgctttgaggacttgctgccgtggctgatggagacactgacctatgagcagagctctgtggatcgctcaggcgctgcacaggggttggctgaggtcatggccggtttgggggtggagaagttggagaagttgatgccagaaatcgtggctacagccagcaaagtggacattgcaccccatgtccgagatggctacattatgatgtttaactacctgcccatcacctttggagacaagtttactccttatgtggggcccatcatcccctgtatcctcaaagctcttgctgatgagaatgagtttgtgcgtgacaccgccctgcgcgcgggccagcgggttatctccatgtacgctgagacagccatcgccctgctgctgccccagctagagcaaggcctctttgatgacctttggagaatcaggttcagctctgttcagctccttggggatctcctgtttcacatctcaggagtcactgggaagatgaccacagaaactgcctctgaggatgataactttggaactgcccagtccaacaaggcgatcatcactgccctgggggtagagcggcggaaccgggtgttggcagggctgtacatgggccgctcagacacccagctggtggtgcggcaggcgtccctgcatgtctggaagattgttgtctccaataccccccgcaccttgcgtgagatcctacccactctctttgggctcctgctgggtttcctggccagcacgtgtgcagataagagaacgattgcagcgagaacattgggagatcttgtgcggaagttaggggagaaaatcctccccgagatcatccccatccttgaggaaggcctgaggtctcagaagagcgatgagaggcagggtgtgtgcattggcctaagtgagatcatgaagtccaccagccgggatgccgtgctgtatttctctgaatccctcgtgcccacggcaaggaaggctttgtgtgacccactggaggaggtcagagaggcggcagccaagactttcgagcagctgcattccaccatcggccaccaggctctggaggacattctcccatttttactaaagcagctggatgacgaggaggtgtcagagtttgccttggatggtctgaagcaagtcatggctattaagagtcgtgtggtgctgccctaccttgtgcccaagctgacaacgccacctgtcaacacccgggtgctggctttcctttcgtcagtggctggtgatgccctcacccgtcatcttggcgtgatcctcccagcggtcatgctggccctgaaggaaaagcttgggaccccagatgagcagctggagatggccaattgtcaggctgtgatcctctccgtagaggatgacacagggcaccggatcatcatcgaggatctgctggaggccacccgcagccctgaggtgggcatgaggcaagctgctgccatcatcctcaacatctactgttcccgctcaaaggctgactacaccagccacctgcggagcctggtctcgggcctgatccgcctcttcaatgactccagccctgtggttctggaggagagctgggatgccctaaatgccatcactaagaagctggatgctggcaaccagttggcactcattgaagagctgcacaaggaaatccggctcatagggaacgagagcaaaggcgagcatgtgccaggattctgcctcccgaagaagggagtgacctccatccttccagtgttgcgggaaggagtcctgactggcagccctgagcagaaggaggaggcagccaaagccttaggcttggtaatccgcctgacctcggctgacgccctgaggccctccgtggtcagcatcactggccctctgatccgcatcctgggggacaggttcagctggaatgtgaaggcggctctgctcgagacactcagcctcttgttggctaaggttgggattgccctgaagcccttcctgccccagctgcagaccactttcaccaaagccctgcaggactccaaccggggggtgcgcctgaaggccgcagatgctctggggaagctcatttccatccacattaaggtggaccccctcttcacagagctgctcaatggcatccgcgccatggaggacccaggtgtcagggacaccatgctgcaggccctgaggtttgtgattcagggagcaggggccaaagtggatgccgtcatccggaaaaacatcgtctcactcctgctgagcatgctgggacacgatgaggacaacactcgcatctcctcagccgggtgcctaggggaactgtgtgcctttttgactgaagaggagcttagtgccgttctacagcagtgcttgctggcggacgtgtccggcattgactggatggttcggcacgggcggagcctggcactttccgtggctgtgaatgtggctcctggcagactttgtgccggcagatatagcagtgatgttcaggaaatgatcctgagcagtgccacggcggacaggatccccattgcggtgagcggggtccggggcatgggctttctcatgagacaccacatcgagacaggcggagggcagttgccggccaaactttccagcctgttcgttaagtgtctgcagaacccatccagcgacatcaggctggtggctgagaagatgatctggtgggcaaataaggacccactgcctcccctggacccccaggccatcaagcccatcctgaaggctcttcttgacaacaccaaggataagaacaccgtggtcagggcctacagcgaccaggcaattgtcaacctcctcaagatgcggcagggtgaagaggtgtttcagtccctctccaagatcctggatgtggccagtttggaggtgctgaacgaggttaaccgaaggtccctgaagaagctggccagccaggccgactccacggagcaggtggacgacaccatcctgacatgagaggcctgggccagcagcagcattgccgctccacatctttgctcaatgttttcatttttgaaaatacatttgttccaatggggagcttggaagatggcgttcccagaaagtattttaatatcaatagaccacagccaaagccttaaatcaaacccacacacaactgaaaattgcctcctccatctctcaccttttcctgtggagaagagaaggaaaagcacacgcatgcgcctcagcaaatggcattcccaagtctggggaggggtataggtttgaaaggctgtttgaaagaggaatgtttaataaaggctttgattt

SEQ ID NO: 1319 - DNA, 8217 bp, Homo sapiens
caggtttccgagacactaaagcgttttgcagggaaggtgacaacagccagtgtaaaggaacggagagaaatcctcagtgaacttgggaagtgtgttgctggaaaagatcttccagagggagcagtgaaggggctctgcaaattgttctgcttgactctgcatcgatatagagatgcagcctcccgcagggccttgcaggcagccatccagcagttggctgaggcccagccagaagccactgctaagaaccttctacactctctgcagtcttctggtataggctccaaagcaggtgttcccagtaagagcagtggctctgccgccttgctggccttgacctggacctgcctcctggtgcgcattgtctttccatcgagagccaagcgacaaggagacatctggaacaaactggtggaagtgcagtgcctgctcttgctggaggtgctgggtggctcccacaagcacgccgtggatggtgctgtgaagaaactcacgaagctgtggaaagaggtgacaggactgcaggggctgaaccccgggctggtggaacagtacttgtcagccattctcagcctagagcccaaccagaactatgctggcatgctggggctgctggtgcagttctgcacgagtcacaaggagatggacgtgagcgccctactggacttttacatgaagaacatcctgatgagcaaagtcaagcctccgaagtacctgttggatagctgtgcccctctgctccgatacctgtcccactcagaatttaaggatctgatactgcccaccatacagaagtccttactgaggagtccagagaatgttattgaaactatttctagtctgctggcatcagtgacgcttgacctcagccagtatgccatggacatcgtgaaaggactggctggtcacctgaaatccaacagtccccgcctgatggatgaagctgtgctggcactgcggaacctggcacgccagtgcagtgactcttcggccatggaatccctgaccaagcacctatttgctatcctcggaggctcggaaggaaaactaactgttgtagcccagaagatgagcgtcctctcagggattgggagcgtcagtcatcacgtggtgtctggaccttccagtcaggtcctgaatgggatcgtggctgagctgttcatcccgttccttcagcaggaagttcatgaagggaccttggtacacgctgtctcagtcctggctctctggtgtaaccgattcactatggaagtgcccaagaagctcactgaatggttcaaaaaagctttcagccttaaaacctccacatctgcggtgaggcatgcctacctgcagtgcatgttggcctcttaccggggtgacacgctgttgcaggccctggacttactgcccttgctcatccagacagtggagaaggcagcctcccaaagcactcaggttcccaccatcactgaaggggttgccgcagccttgttgctcttaaagttgtcagtggctgactcacaggctgaggccaaactgagcagtttctggcagttgattgtggatgagaaaaagcaggttttcacttctgagaaattcctggtcatggcttcagaggatgccctgtgtactgtgttgcatctgacagagagacttttccttgaccacccgcatagactcactggcaacaaagttcagcagtaccaccgggctctggtggcggtgctcctgagccgcacctggcacgtccgcaggcaggctcagcagacagttcggaagctgctgtcctctcttgggggctttaagctggcgcacggactcttggaggagctgaagactgtcctcagttctcacaaggtgctgcccttagaggctttggtgactgatgctggagaggtgactgaggcaggcaaggcctacgtgcctccacgggtcctgcaggaggctctgtgtgtcatctccggtgtgccagggctcaagggtgatgtcaccgacactgaacaactggcccaggaaatgctgatcatctcccaccacccatccttaggtccgtggctgcggtggtcctccatgaatgccatgggctccctttccgtcctgtcgccggaccgggtcctcccacagctcatcagcaccatcactgcctccgtgcagaaccctgcactgcgcctggtgacgcgggaggagtttgccattatgcagacccctgctggggagctgtatgacaaatccatcattcagagtgcccagcaggacagcataaaaaaggccaacatgaagcgagagaacaaagcttattccttcaaagagcagatcatcgagctggagctgaaggaggagataaagaagaagaaaggcatcaaagaggaggtgcagctgaccagcaagcagaaggagatgctgcaggcccagctagacagggaggcgcaggtccggaggcggctgcaggagctggatggggagctggaggcggcgcttggactgctggacatcatcctggccaagaacccgtccggcctgacccagtacatccctgttttggtcgactcttttctgcccttgctgaagtctcccctggctgctcccaggatcaagaaccccttcttgtccttggctgcctgtgtcatgccctctaggctcaaggctttgggcactttggtgagccacgtgaccctgcgcctgctgaagccagagtgtgtcctggataagtcctggtgccaggaagagctgtcggtggctgtgaagagggcggtgatgctgctgcacacccacaccatcaccagcagggtgggcaagggggagccaggtgctgcgcccttgtccgcgccagccttctccttagtcttcccgtttctgaagatggtgctgacggagatgccccaccacagtgaggaggaggaggagtggatggcccagattcttcagatcctcactgtccaagcccagctgagggcctcccccaacaccccacccgggcgggtggacgagaatggcccggagttgctgcctcgcgtggccatgctgcgtcttctgacttgggtgatcgggacgggctcgcctcgcttacaggttctggcttcagacaccctgaccaccctgtgtgccagcagcagtggtgatgatggctgtgcctttgcagagcaggaggaggtggacgtgctgctctgtgccttgcagtccccgtgtgccagcgtgcgggaaaccgtgctccgggggctgatggaactccacatggtattgccagcacctgatactgatgagaagaatggcctgaaccttctgcggagactctgggtggtcaagtttgacaaggaggaggagatccggaagctggctgagaggctctggtcaatgatgggcctagacctgcagccagacctctgctccttgctgattgacgacgtgatctatcatgaggcggctgtaaggcaggcaggggccgaagccctctcccaagcagtggcacgttaccagcggcaggcggcggaggttatgggcaggctcatggagatttaccaggaaaagctctaccggccgcccccagtgctggatgctttgggacgagttatttcagaatctcctccagatcagtgggaagccaggtgtggcttggcgttggccctcaacaagctctcccagtatttggacagctctcaggtgaagccactctttcagttttttgtccctgatgccctcaatgaccgacacccagatgtccggaagtgcatgttggatgcagccctcgcaacgctcaacactcatgggaaggagaacgtcaactcgctgttgccagtattcgaggagttcctgaagaacgcgcccaatgatgccagctatgatgctgtgcgacagagtgtggtggtcctgatgggctctctggccaagcacctggacaagagtgaccccaaagtgaagcccattgttgccaagctcatcgctgccctctccaccccctcccagcaggtccaggagtccgtagccagctgcttgccacccctcgtgccagccatcaaggaggatgctggagggatgatccagaggcttatgcagcagctgctggagtcagacaagtacgcagagcgcaaaggggccgcctatggcctggcgggcctggtgaagggcctgggcatcctctcgctgaagcaacaggagatgatggcggcactgactgatgccatccaagataagaagaacttccgccggcgagagggagccctctttgccttcgagatgctctgcaccatgctggggaaactttttgagccgtatgtggttcacgtgctgccccatctgctcctgtgctttggggatggaaaccagtatgtgcgtgaggctgcagatgactgtgccaaggctgtgatgagcaacttgagtgctcacggggtgaagctggtgctcccctccttactggctgccctggaggaggaatcgtggcggaccaaagctgggtcagtggagcttcttggggcaatggcgtactgtgctcctaagcagctgtcatcctgtctacccaacattgtgcccaagcttacggaggtgctgaccgactcccatgtcaaagtccagaaggctggacagcaggcgctcaggcagatcggctccgttatcaggaacccggagatcctggccattgctccagtcctcctggatgccctgacggatccctccaggaagacccagaagtgcttgcagaccctgctggacaccaagtttgtccacttcattgatgccccatccctggccctcatcatgcccattgtccagagagccttccaggaccgttccacggacacgcggaagatggcagcccagattattggcaacatgtactccctgacagaccagaaggacttggctccgtacctgcccagcgtgacgcctggcctgaaagcatcgcttttggaccctgtgcctgaggtgcggaccgtatctgcaaaggcccttggggccatggtgaagggcatgggggagtcgtgctttgaggacttgctgccgtggctgatggagacactgacctatgagcagagctctgtggatcgctcaggcgctgcacaggggttggctgaggtcatggccggtttgggggtggagaagttggagaagttgatgccagaaatcgtggctacagccagcaaagtggacattgcaccccatgtccgagatggctacattatgatgtttaactacctgcccatcacctttggagacaagtttactccttatgtggggcccatcatcccctgtatcctcaaagctcttgctgatgagaatgagtttgtgcgtgacaccgccctgcgcgcgggccagcgggttatctccatgtacgctgagacagccatcgccctgctgctgccccagctagagcaaggcctctttgatgacctttggagaatcaggttcagctctgttcagctccttggggatctcctgtttcacatctcaggagtcactgggaagatgaccacagaaactgcctctgaggatgataactttggaactgcccagtccaacaaggcgatcatcactgccctgggggtagagcggcggaaccgggtgttggcagggctgtacatgggccgctcagacacccagctggtggtgcggcaggcgtccctgcatgtctggaagattgttgtctccaataccccccgcaccttgcgtgagatcctacccactctctttgggctcctgctgggtttcctggccagcacgtgtgcagataagagaacgattgcagcgagaacattgggagatcttgtgcggaagttaggggagaaaatcctccccgagatcatccccatccttgaggaaggcctgaggtctcagaagagcgatgagaggcagggtgtgtgcattggcctaagtgagatcatgaagtccaccagccgggatgccgtgctgtatttctctgaatccctcgtgcccacggcaaggaaggctttgtgtgacccactggaggaggtcagagaggcggcagccaagactttcgagcagctgcattccaccatcggccaccaggctctggaggacattctcccatttttactaaagcagctggatgacgaggaggtgtcagagtttgccttggatggtctgaagcaagtcatggctattaagagtcgtgtggtgctgccctaccttgtgcccaagctgacaacgccacctgtcaacacccgggtgctggctttcctttcgtcagtggctggtgatgccctcacccgtcatcttggcgtgatcctcccagcggtcatgctggccctgaaggaaaagcttgggaccccagatgagcagctggagatggccaattgtcaggctgtgatcctctccgtagaggatgacacagggcaccggatcatcatcgaggatctgctggaggccacccgcagccctgaggtgggcatgaggcaagctgctgccatcatcctcaacatctactgttcccgctcaaaggctgactacaccagccacctgcggagcctggtctcgggcctgatccgcctcttcaatgactccagccctgtggttctggaggagagctgggatgccctaaatgccatcactaagaagctggatgctggcaaccagttggcactcattgaagagctgcacaaggaaatccggctcatagggaacgagagcaaaggcgagcatgtgccaggattctgcctcccgaagaagggagtgacctccatccttccagtgttgcgggaaggagtcctgactggcagccctgagcagaaggaggaggcagccaaagccttaggcttggtaatccgcctgacctcggctgacgccctgaggccctccgtggtcagcatcactggccctctgatccgcatcctgggggacaggttcagctggaatgtgaaggcggctctgctcgagacactcagcctcttgttggctaaggttgggattgccctgaagcccttcctgccccagctgcagaccactttcaccaaagccctgcaggactccaaccggggggtgcgcctgaaggccgcagatgctctggggaagctcatttccatccacattaaggtggaccccctcttcacagagctgctcaatggcatccgcgccatggaggacccaggtgtcagggacaccatgctgcaggccctgaggtttgtgattcagggagcaggggccaaagtggatgccgtcatccggaaaaacatcgtctcactcctgctgagcatgctgggacacgatgaggacaacactcgcatctcctcagccgggtgcctaggggaactgtgtgcctttttgactgaagaggagcttagtgccgttctacagcagtgcttgctggcggacgtgtccggcattgactggatggttcggcacgggcggagcctggcactttccgtggctgtgaatgtggctcctggcagactttgtgccggcagatatagcagtgatgttcaggaaatgatcctgagcagtgccacggcggacaggatccccattgcggtgagcggggtccggggcatgggctttctcatgagacaccacatcgagacaggcggagggcagttgccggccaaactttccagcctgttcgttaagtgtctgcagaacccatccagcgacatcaggctggtggctgagaagatgatctggtgggcaaataaggacccactgcctcccctggacccccaggccatcaagcccatcctgaaggctcttcttgacaacaccaaggataagaacaccgtggtcagggcctacagcgaccaggcaattgtcaacctcctcaagatgcggcagggtgaagaggtgtttcagtccctctccaagatcctggatgtggccagtttggaggtgctgaacgaggttaaccgaaggtccctgaagaagctggccagccaggccgactccacggagcaggtggacgacaccatcctgacatgagaggcctgggccagcagcagcattgccgctccacatctttgctcaatgttttcatttttgaaaatacatttgttccaatggggagcttggaagatggcgttcccagaaagtattttaatatcaatagaccacagccaaagccttaaatcaaacccacacacaactgaaaattgcctcctccatctctcaccttttcctgtggagaagagaaggaaaagcacacgcatgcgcctcagcaaatggcattcccaagtctggggaggggtataggtttgaaaggctgtttgaaagaggaatgtttaataaaggctttgattt

SEQ ID NO: 1320 - DNA, 8668 bp, Homo sapiens
cagccccggcaggatggcggcggacacgcaggtttccgagacactaaagcgttttgcagggaaggtgacaacagccagtgtaaaggaacggagagaaatcctcagtgaacttgggaagtgtgttgctggaaaagatcttccagagggagcagtgaaggggctctgcaaattgttctgcttgactctgcatcgatatagagatgcagcctcccgcagggccttgcaggcagccatccagcagttggctgaggcccagccagaagccactgctaagaaccttctacactctctgcagtcttctggtataggctccaaagcaggtgttcccagtaagagcagtggctctgccgccttgctggccttgacctggacctgcctcctggtgcgcattgtctttccatcgagagccaagcgacaaggagacatctggaacaaactggtggaagtgcagtgcctgctcttgctggaggtgctgggtggctcccacaagcacgccgtggatggtgctgtgaagaaactcacgaagctgtggaaagagaaccccgggctggtggaacagtacttgtcagccattctcagcctagagcccaaccagaactatgctggcatgctggggctgctggtgcagttctgcacgagtcacaaggagatggacgtggtcagtcagcacaagagcgccctactggacttttacatgaagaacatcctgatgagcaaagtcaagcctccgaagtacctgttggatagctgtgcccctctgctccgatacctgtcccactcagaatttaaggatctgatactgcccaccatacagaagtccttactgaggagtccagagaatgttattgaaactatttctagtctgctggcatcagtgacgcttgacctcagccagtatgccatggacatcgtgaaaggactggctggtcacctgaaatccaacagtccccgcctgatggatgaagctgtgctggcactgcggaacctggcacgccagtgcagtgactcttcggccatggaatccctgaccaagcacctatttgctatcctcggaggctcggaaggaaaactaactgttgtagcccagaagatgagcgtcctctcagggattgggagcgtcagtcatcacgtggtgtctggaccttccagtcaggtcctgaatgggatcgtggctgagctgttcatcccgttccttcagcaggaagttcatgaagggaccttggtacacgctgtctcagtcctggctctctggtgtaaccgattcactatggaagtgcccaagaagctcactgaatggttcaaaaaagctttcagccttaaaacctccacatctgcggtgaggcatgcctacctgcagtgcatgttggcctcttaccggggtgacacgctgttgcaggccctggacttactgcccttgctcatccagacagtggagaaggcagcctcccaaagcactcaggttcccaccatcactgaaggggttgccgcagccttgttgctcttaaagttgtcagtggctgactcacaggctgaggccaaactgagcagtttctggcagttgattgtggatgagaaaaagcaggttttcacttctgagaaattcctggtcatggcttcagaggatgccctgtgtactgtgttgcatctgacagagagacttttccttgaccacccgcatagactcactggcaacaaagttcagcagtaccaccgggctctggtggcggtgctcctgagccgcacctggcacgtccgcaggcaggctcagcagacagttcggaagctgctgtcctctcttgggggctttaagctggcgcacggactcttggaggagctgaagactgtcctcagttctcacaaggtgctgcccttagaggctttggtgactgatgctggagaggtgactgaggcaggcaaggcctacgtgcctccacgggtcctgcaggaggctctgtgtgtcatctccggtgtgccagggctcaagggtgatgtcaccgacactgaacaactggcccaggaaatgctgatcatctcccaccacccatccttagttgccgtgcagtctggactttggccagcacttcttgccaggatgaagatcgatcctgaagcctttatcaccaggcacctggatcagatcattcccaggatgaccacacagagtcccctaaaccagtcctccatgaatgccatgggctccctttccgtcctgtcgccggaccgggtcctcccacagctcatcagcaccatcactgcctccgtgcagaaccctgcactgcgcctggtgacgcgggaggagtttgccattatgcagacccctgctggggagctgtatgacaaatccatcattcagagtgcccagcaggacagcataaaaaaggccaacatgaagcgagagaacaaagcttattccttcaaagagcagatcatcgagctggagctgaaggaggagataaagaagaagaaaggcatcaaagaggaggtgcagctgaccagcaagcagaaggagatgctgcaggcccagctagacagggaggcgcaggtccggaggcggctgcaggagctggatggggagctggaggcggcgcttggactgctggacatcatcctggccaagaacccgtccggcctgacccagtacatccctgttttggtcgactcttttctgcccttgctgaagtctcccctggctgctcccaggatcaagaaccccttcttgtccttggctgcctgtgtcatgccctctaggctcaaggctttgggcactttggtgagccacgtgaccctgcgcctgctgaagccagagtgtgtcctggataagtcctggtgccaggaagagctgtcggtggctgtgaagagggcggtgatgctgctgcacacccacaccatcaccagcagggtgggcaagggggagccaggtgctgcgcccttgtccgcgccagccttctccttagtcttcccgtttctgaagatggtgctgacggagatgccccaccacagtgaggaggaggaggagtggatggcccagattcttcagatcctcactgtccaagcccagctgagggcctcccccaacaccccacccgggcgggtggacgagaatggcccggagttgctgcctcgcgtggccatgctgcgtcttctgacttgggtgatcgggacgggctcgcctcgcttacaggttctggcttcagacaccctgaccaccctgtgtgccagcagcagtggtgatgatggctgtgcctttgcagagcaggaggaggtggacgtgctgctctgtgccttgcagtccccgtgtgccagcgtgcgggaaaccgtgctccgggggctgatggaactccacatggtattgccagcacctgatactgatgagaagaatggcctgaaccttctgcggagactctgggtggtcaagtttgacaaggaggaggagatccggaagctggctgagaggctctggtcaatgatgggcctagacctgcagccagacctctgctccttgctgattgacgacgtgatctatcatgaggcggctgtaaggcaggcaggggccgaagccctctcccaagcagtggcacgttaccagcggcaggcggcggaggttatgggcaggctcatggagatttaccaggaaaagctctaccggccgcccccagtgctggatgctttgggacgagttatttcagaatctcctccagatcagtgggaagccaggtgtggcttggcgttggccctcaacaagctctcccagtatttggacagctctcaggtgaagccactctttcagttttttgtccctgatgccctcaatgaccgacacccagatgtccggaagtgcatgttggatgcagccctcgcaacgctcaacactcatgggaaggagaacgtcaactcgctgttgccagtattcgaggagttcctgaagaacgcgcccaatgatgccagctatgatgctgtgcgacagagtgtggtggtcctgatgggctctctggccaagcacctggacaagagtgaccccaaagtgaagcccattgttgccaagctcatcgctgccctctccaccccctcccagcaggtccaggagtccgtagccagctgcttgccaccccttgtgccagccatcaaggaggatgctggagggatgatccagaggcttatgcagcagctgctggagtcagacaagtacgcagagcgcaaaggggccgcctatggcctggcgggcctggtgaagggcctgggcatcctctcgctgaagcaacaggagatgatggcggcactgactgatgccatccaagataagaagaacttccgccggcgagagggagccctctttgccttcgagatgctctgcaccatgctggggaaactttttgagccgtatgtggttcacgtgctgccccatctgctcctgtgctttggggatggaaaccagtatgtgcgtgaggctgcagatgactgtgccaaggctgtgatgagcaacttgagtgctcacggggtgaagctggtgctcccctccttactggctgccctggaggaggaatcgtggcggaccaaagctgggtcagtggagcttcttggggcaatggcgtactgtgctcctaagcagctgtcatcctgtctacccaacattgtgcccaagcttacggaggtgctgaccgactcccatgtcaaagtccagaaggctggacagcaggcgctcaggcagatcggctccgttatcaggaacccggagatcctggccattgctccagtcctcctggatgccctgacggatccctccaggaagacccagaagtgcttgcagaccctgctggacaccaagtttgtccacttcattgatgccccatccctggccctcatcatgcccattgtccagagagccttccaggaccgttccacggacacgcggaagatggcagcccagattattggcaacatgtactccctgacagaccagaaggacttggctccgtacctgcccagcgtgacgcctggcctgaaagcatcgcttttggaccctgtgcctgaggtgcggaccgtatctgcaaaggcccttggggccatggtgaagggcatgggggagtcgtgctttgaggacttgctgccgtggctgatggagacactgacctatgagcagagctctgtggatcgctcaggcgctgcacaggggttggctgaggtcatggccggtttgggggtggagaagttggagaagttgatgccagaaatcgtggctacagccagcaaagtggacattgcaccccatgtccgagatggctacattatgatgtttaactacctgcccatcacctttggagacaagtttactccttatgtggggcccatcatcccctgtatcctcaaagctcttgctgatgagaatgagtttgtgcgtgacaccgccctgcgcgcgggccagcgggttatctccatgtacgctgagacagccatcgccctgctgctgccccagctagagcaaggcctctttgatgacctttggagaatcaggttcagctctgttcagctccttggggatctcctgtttcacatctcaggagtcactgggaagatgaccacagaaactgcctctgaggatgataactttggaactgcccagtccaacaaggcgatcatcactgccctgggggtagagcggcggaaccgggtgttggcagggctgtacatgggccgctcagacacccagctggtggtgcggcaggcgtccctgcatgtctggaagattgttgtctccaataccccccgcaccttgcgtgagatcctacccactctctttgggctcctgctgggtttcctggccagcacgtgtgcagataagagaacgattgcagcgagaacattgggagatcttgtgcggaagttaggggagaaaatcctccccgagatcatccccatccttgaggaaggcctgaggtctcagaagagcgatgagaggcagggtgtgtgcattggcctaagtgagatcatgaagtccaccagccgggatgccgtgctgtatttctctgaatccctcgtgcccacggcaaggaaggctttgtgtgacccactggaggaggtcagagaggcggcagccaagactttcgagcagctgcattccaccatcggccaccaggctctggaggacattctcccatttttactaaagcagctggatgacgaggaggtgtcagagtttgccttggatggtctgaagcaagtcatggctattaagagtcgtgtggtgctgccctaccttgtgcccaagctgacaacgccacctgtcaacacccgggtgctggctttcctttcgtcagtggctggtgatgccctcacccgtcatcttggcgtgatcctcccagcggtcatgctggccctgaaggaaaagcttgggaccccagatgagcagctggagatggccaattgtcaggctgtgatcctctccgtagaggatgacacagggcaccggatcatcatcgagtatctgctggaggccacccgcagccctgaggtgggcatgaggcaagctgctgccatcatcctcaacatctactgttcccgctcaaaggctgactacaccagccacctgcggagcctggtctcgggcctgatccgcctcttcaatgactccagccctgtggttctggaggagagctgggatgccctaaatgccatcactaagaagctggatgctggcaaccagttggcactcattgaagagctgcacaaggaaatccggctcatagggaacgagagcaaaggcgagcatgtgccaggattctgcctcccgaagaagggagtgacctccatccttccagtgttgcgggaaggagtcctgactggcagccctgagcagaaggaggaggcagccaaagccttaggcttggtaatccgcctgacctcggctgacgccctgaggccctccgtggtcagcatcactggccctctgatccgcatcctgggggacaggttcagctggaatgtgaaggcggctctgctcgagacactcagcctcttgttggctaaggttgggattgccctgaagcccttcctgccccagctgcagaccactttcaccaaagccctgcaggactccaaccggggggtgcgcctgaaggccgcagatgctctggggaagctcatttccatccacattaaggtggaccccctcttcacagagctgctcaatggcatccgcgccatggaggacccaggtgtcagggacaccatgctgcaggccctgaggtttgtgattcagggagcaggggccaaagtggatgccgtcatccggaaaaacatcgtctcactcctgctgagcatgctgggacacgatgaggacaacactcgcatctcctcagccgggtgcctaggggaactgtgtgcctttttgactgaagaggagcttagtgccgttctacagcagtgcttgctggcggacgtgtccggcattgactggatggttcggcacgggcggagcctggcactttccgtggctgtgaatgtggctcctggcagactttgtgccggcagatatagcagtgatgttcaggaaatgatcctgagcagtgccacggcggacaggatccccattgcggtgagcggggtccggggcatgggctttctcatgagacaccacatcgagacaggcggagggcagttgccggccaaactttccagcctgttcgttaagtgtctgcagaacccatccagcgacatcaggctggtggctgagaagatgatctggtgggcaaataaggacccactgcctcccctggacccccaggccatcaagcccatcctgaaggctcttcttgacaacaccaaggataagaacaccgtggtcagggcctacagcgaccaggcaattgtcaacctcctcaagatgcggcagggtgaagaggtgtttcagtccctctccaagatcctggatgtggccagtttggaggtgctgaacgaggttaaccgaaggtccctgaagaagctggccagccaggccgactccacggagcaggtggacgacaccatcctgacatgagaggcctgggccagcagcagcattgccgctccacatctttgctcaatgttttcatttttgaaaatacatttgttccaatggggagcttggaagatggcgttcccagaaagtattttaatatcaatagaccacagccaaagccttaaatcaaacccacacacaactgaaaattgcctcctccatctctcaccttttcctgtggagaagagaaggaaaagcacacgcatgcgcctcagcaaatggcagcccaggagctgtttgtccagtttagcatggctaggtctggaactataatagcagggtcagactgtgggttcctcttctcctgtgcttgagctctggtttgagagctggcgctaccaacctttttcctatatcccgagtggggcacagacggtggatctctgcccagtgtggtgtgtctggcttggcttttcaatattgtgaggtctgaatggatctgacccctgtcagatgaaaatgattcacagctctggcagttcccaagtctggggaggggtataggtttgaaaggctgtttgaaagaggaatgtttaataaaggctttgatttaatcttgatataaacagatttttaaaaatctccacccattaaacatgaagcttcctgcatcaggaa

SEQ ID NO: 1321 - DNA, 8538 bp, Homo sapiens
caggtttccgagacactaaagcgttttgcagggaaggtgacaacagccagtgtaaaggaacggagagaaatcctcagtgaacttgggaagtgtgttgctggaaaagatcttccagagggagcagtgaaggggctctgcaaattgttctgcttgactctgcatcgatatagagatgcagcctcccgcagggccttgcaggcagccatccagcagttggctgaggcccagccagaagccactgctaagaaccttctacactctctgcagtcttctggtataggctccaaagcaggtgttcccagtaagagcagtggctctgccgccttgctggccttgacctggacctgcctcctggtgcgcattgtctttccatcgagagccaagcgacaaggagacatctggaacaaactggtggaagtgcagtgcctgctcttgctggaggtgctgggtggctcccacaagcacgccgtggatggtgctgtgaagaaactcacgaagctgtggaaagaggtgacaggactgcaggggctgaaccccgggctggtggaacagtacttgtcagccattctcagcctagagcccaaccagaactatgctggcatgctggggctgctggtgcagttctgcacgagtcacaaggagatggacgtgagcgccctactggacttttacatgaagaacatcctgatgagcaaagtcaagcctccgaagtacctgttggatagctgtgcccctctgctccgatacctgtcccactcagaatttaaggatctgatactgcccaccatacagaagtccttactgaggagtccagagaatgttattgaaactatttctagtctgctggcatcagtgacgcttgacctcagccagtatgccatggacatcgtgaaaggactggctggtcacctgaaatccaacagtccccgcctgatggatgaagctgtgctggcactgcggaacctggcacgccagtgcagtgactcttcggccatggaatccctgaccaagcacctatttgctatcctcggaggctcggaaggaaaactaactgttgtagcccagaagatgagcgtcctctcagggattgggagcgtcagtcatcacgtggtgtctggaccttccagtcaggtcctgaatgggatcgtggctgagctgttcatcccgttccttcagcaggaagttcatgaagggaccttggtacacgctgtctcagtcctggctctctggtgtaaccgattcactatggaagtgcccaagaagctcactgaatggttcaaaaaagctttcagccttaaaacctccacatctgcggtgaggcatgcctacctgcagtgcatgttggcctcttaccggggtgacacgctgttgcaggccctggacttactgcccttgctcatccagacagtggagaaggcagcctcccaaagcactcaggttcccaccatcactgaaggggttgccgcagccttgttgctcttaaagttgtcagtggctgactcacaggctgaggccaaactgagcagtttctggcagttgattgtggatgagaaaaagcaggttttcacttctgagaaattcctggtcatggcttcagaggatgccctgtgtactgtgttgcatctgacagagagacttttccttgaccacccgcatagactcactggcaacaaagttcagcagtaccaccgggctctggtggcggtgctcctgagccgcacctggcacgtccgcaggcaggctcagcagacagttcggaagctgctgtcctctcttgggggctttaagctggcgcacggactcttggaggagctgaagactgtcctcagttctcacaaggtgctgcccttagaggctttggtgactgatgctggagaggtgactgaggcaggcaaggcctacgtgcctccacgggtcctgcaggaggctctgtgtgtcatctccggtgtgccagggctcaagggtgatgtcaccgacactgaacaactggcccaggaaatgctgatcatctcccaccacccatccttaggtccgtggctgcggtggtcctccatgaatgccatgggctccctttccgtcctgtcgccggaccgggtcctcccacagctcatcagcaccatcactgcctccgtgcagaaccctgcactgcgcctggtgacgcgggaggagtttgccattatgcagacccctgctggggagctgtatgacaaatccatcattcagagtgcccagcaggacagcataaaaaaggccaacatgaagcgagagaacaaagcttattccttcaaagagcagatcatcgagctggagctgaaggaggagataaagaagaagaaaggcatcaaagaggaggtgcagctgaccagcaagcagaaggagatgctgcaggcccagctagacagggaggcgcaggtccggaggcggctgcaggagctggatggggagctggaggcggcgcttggactgctggacatcatcctggccaagaacccgtccggcctgacccagtacatccctgttttggtcgactcttttctgcccttgctgaagtctcccctggctgctcccaggatcaagaaccccttcttgtccttggctgcctgtgtcatgccctctaggctcaaggctttgggcactttggtgagccacgtgaccctgcgcctgctgaagccagagtgtgtcctggataagtcctggtgccaggaagagctgtcggtggctgtgaagagggcggtgatgctgctgcacacccacaccatcaccagcagggtgggcaagggggagccaggtgctgcgcccttgtccgcgccagccttctccttagtcttcccgtttctgaagatggtgctgacggagatgccccaccacagtgaggaggaggaggagtggatggcccagattcttcagatcctcactgtccaagcccagctgagggcctcccccaacaccccacccgggcgggtggacgagaatggcccggagttgctgcctcgcgtggccatgctgcgtcttctgacttgggtgatcgggacgggctcgcctcgcttacaggttctggcttcagacaccctgaccaccctgtgtgccagcagcagtggtgatgatggctgtgcctttgcagagcaggaggaggtggacgtgctgctctgtgccttgcagtccccgtgtgccagcgtgcgggaaaccgtgctccgggggctgatggaactccacatggtattgccagcacctgatactgatgagaagaatggcctgaaccttctgcggagactctgggtggtcaagtttgacaaggaggaggagatccggaagctggctgagaggctctggtcaatgatgggcctagacctgcagccagacctctgctccttgctgattgacgacgtgatctatcatgaggcggctgtaaggcaggcaggggccgaagccctctcccaagcagtggcacgttaccagcggcaggcggcggaggttatgggcaggctcatggagatttaccaggaaaagctctaccggccgcccccagtgctggatgctttgggacgagttatttcagaatctcctccagatcagtgggaagccaggtgtggcttggcgttggccctcaacaagctctcccagtatttggacagctctcaggtgaagccactctttcagttttttgtccctgatgccctcaatgaccgacacccagatgtccggaagtgcatgttggatgcagccctcgcaacgctcaacactcatgggaaggagaacgtcaactcgctgttgccagtattcgaggagttcctgaagaacgcgcccaatgatgccagctatgatgctgtgcgacagagtgtggtggtcctgatgggctctctggccaagcacctggacaagagtgaccccaaagtgaagcccattgttgccaagctcatcgctgccctctccaccccctcccagcaggtccaggagtccgtagccagctgcttgccacccctcgtgccagccatcaaggaggatgctggagggatgatccagaggcttatgcagcagctgctggagtcagacaagtacgcagagcgcaaaggggccgcctatggcctggcgggcctggtgaagggcctgggcatcctctcgctgaagcaacaggagatgatggcggcactgactgatgccatccaagataagaagaacttccgccggcgagagggagccctctttgccttcgagatgctctgcaccatgctggggaaactttttgagccgtatgtggttcacgtgctgccccatctgctcctgtgctttggggatggaaaccagtatgtgcgtgaggctgcagatgactgtgccaaggctgtgatgagcaacttgagtgctcacggggtgaagctggtgctcccctccttactggctgccctggaggaggaatcgtggcggaccaaagctgggtcagtggagcttcttggggcaatggcgtactgtgctcctaagcagctgtcatcctgtctacccaacattgtgcccaagcttacggaggtgctgaccgactcccatgtcaaagtccagaaggctggacagcaggcgctcaggcagatcggctccgttatcaggaacccggagatcctggccattgctccagtcctcctggatgccctgacggatccctccaggaagacccagaagtgcttgcagaccctgctggacaccaagtttgtccacttcattgatgccccatccctggccctcatcatgcccattgtccagagagccttccaggaccgttccacggacacgcggaagatggcagcccagattattggcaacatgtactccctgacagaccagaaggacttggctccgtacctgcccagcgtgacgcctggcctgaaagcatcgcttttggaccctgtgcctgaggtgcggaccgtatctgcaaaggcccttggggccatggtgaagggcatgggggagtcgtgctttgaggacttgctgccgtggctgatggagacactgacctatgagcagagctctgtggatcgctcaggcgctgcacaggggttggctgaggtcatggccggtttgggggtggagaagttggagaagttgatgccagaaatcgtggctacagccagcaaagtggacattgcaccccatgtccgagatggctacattatgatgtttaactacctgcccatcacctttggagacaagtttactccttatgtggggcccatcatcccctgtatcctcaaagctcttgctgatgagaatgagtttgtgcgtgacaccgccctgcgcgcgggccagcgggttatctccatgtacgctgagacagccatcgccctgctgctgccccagctagagcaaggcctctttgatgacctttggagaatcaggttcagctctgttcagctccttggggatctcctgtttcacatctcaggagtcactgggaagatgaccacagaaactgcctctgaggatgataactttggaactgcccagtccaacaaggcgatcatcactgccctgggggtagagcggcggaaccgggtgttggcagggctgtacatgggccgctcagacacccagctggtggtgcggcaggcgtccctgcatgtctggaagattgttgtctccaataccccccgcaccttgcgtgagatcctacccactctctttgggctcctgctgggtttcctggccagcacgtgtgcagataagagaacgattgcagcgagaacattgggagatcttgtgcggaagttaggggagaaaatcctccccgagatcatccccatccttgaggaaggcctgaggtctcagaagagcgatgagaggcagggtgtgtgcattggcctaagtgagatcatgaagtccaccagccgggatgccgtgctgtatttctctgaatccctcgtgcccacggcaaggaaggctttgtgtgacccactggaggaggtcagagaggcggcagccaagactttcgagcagctgcattccaccatcggccaccaggctctggaggacattctcccatttttactaaagcagctggatgacgaggaggtgtcagagtttgccttggatggtctgaagcaagtcatggctattaagagtcgtgtggtgctgccctaccttgtgcccaagctgacaacgccacctgtcaacacccgggtgctggctttcctttcgtcagtggctggtgatgccctcacccgtcatcttggcgtgatcctcccagcggtcatgctggccctgaaggaaaagcttgggaccccagatgagcagctggagatggccaattgtcaggctgtgatcctctccgtagaggatgacacagggcaccggatcatcatcgaggatctgctggaggccacccgcagccctgaggtgggcatgaggcaagctgctgccatcatcctcaacatctactgttcccgctcaaaggctgactacaccagccacctgcggagcctggtctcgggcctgatccgcctcttcaatgactccagccctgtggttctggaggagagctgggatgccctaaatgccatcactaagaagctggatgctggcaaccagttggcactcattgaagagctgcacaaggaaatccggctcatagggaacgagagcaaaggcgagcatgtgccaggattctgcctcccgaagaagggagtgacctccatccttccagtgttgcgggaaggagtcctgactggcagccctgagcagaaggaggaggcagccaaagccttaggcttggtaatccgcctgacctcggctgacgccctgaggccctccgtggtcagcatcactggccctctgatccgcatcctgggggacaggttcagctggaatgtgaaggcggctctgctcgagacactcagcctcttgttggctaaggttgggattgccctgaagcccttcctgccccagctgcagaccactttcaccaaagccctgcaggactccaaccggggggtgcgcctgaaggccgcagatgctctggggaagctcatttccatccacattaaggtggaccccctcttcacagagctgctcaatggcatccgcgccatggaggacccaggtgtcagggacaccatgctgcaggccctgaggtttgtgattcagggagcaggggccaaagtggatgccgtcatccggaaaaacatcgtctcactcctgctgagcatgctgggacacgatgaggacaacactcgcatctcctcagccgggtgcctaggggaactgtgtgcctttttgactgaagaggagcttagtgccgttctacagcagtgcttgctggcggacgtgtccggcattgactggatggttcggcacgggcggagcctggcactttccgtggctgtgaatgtggctcctggcagactttgtgccggcagatatagcagtgatgttcaggaaatgatcctgagcagtgccacggcggacaggatccccattgcggtgagcggggtccggggcatgggctttctcatgagacaccacatcgagacaggcggagggcagttgccggccaaactttccagcctgttcgttaagtgtctgcagaacccatccagcgacatcaggctggtggctgagaagatgatctggtgggcaaataaggacccactgcctcccctggacccccaggccatcaagcccatcctgaaggctcttcttgacaacaccaaggataagaacaccgtggtcagggcctacagcgaccaggcaattgtcaacctcctcaagatgcggcagggtgaagaggtgtttcagtccctctccaagatcctggatgtggccagtttggaggtgctgaacgaggttaaccgaaggtccctgaagaagctggccagccaggccgactccacggagcaggtggacgacaccatcctgacatgagaggcctgggccagcagcagcattgccgctccacatctttgctcaatgttttcatttttgaaaatacatttgttccaatggggagcttggaagatggcgttcccagaaagtattttaatatcaatagaccacagccaaagccttaaatcaaacccacacacaactgaaaattgcctcctccatctctcaccttttcctgtggagaagagaaggaaaagcacacgcatgcgcctcagcaaatggcagcccaggagctgtttgtccagtttagcatggctaggtctggaactataatagcagggtcagactgtgggttcctcttctcctgtgcttgagctctggtttgagagctggcgctaccaacctttttcctatatcccgagtggggcacagacggtggatctctgcccagtgtggtgtgtctggcttggcttttcaatattgtgaggtctgaatggatctgatccctgtcagatgaaaatgattcacagctctggcagttcccaagtctggggaggggtataggtttgaaaggctgtttgaaagaggaatgtttaataaaggctttgatttaatcttgatataaacagatttttaaaaatctccacccattaaacatgaagcttcctgcatcaggaa

SEQ ID NO: 1322 - DNA, 3127 bp, Homo sapiens
gagatacccggccagacaccctcacctgcggtgcccagctgcccaggctgaggcaagagaaggccagaaaccatgcccatggggtctctgcaaccgctggccaccttgtacctgctggggatgctggtcgcttcctgcctcggacggctcagctggtatgacccagatttccaggcaaggctcacccgttccaactcgaagtgccagggccagctggaggtctacctcaaggacggatggcacatggtttgcagccagagctggggccggagctccaagcagtgggaggaccccagtcaagcgtcaaaagtctgccagcggctgaactgtggggtgcccttaagccttggccccttccttgtcacctacacacctcagagctcaatcatctgctacggacaactgggctccttctccaactgcagccacagcagaaatgacatgtgtcactctctgggcctgacctgcttagaaccccagaagacaacacctccaacgacaaggcccccgcccaccacaactccagagcccacagctcctcccaggctgcagctggtggcacagtctggcggccagcactgtgccggcgtggtggagttctacagcggcagcctggggggtaccatcagctatgaggcccaggacaagacccaggacctggagaacttcctctgcaacaacctccagtgtggctccttcttgaagcatctgccagagactgaggcaggcagagcccaagacccaggggagccacgggaacaccagcccttgccaatccaatggaagatccagaactcaagctgtacctccctggagcattgcttcaggaaaatcaagccccagaaaagtggccgagttcttgccctcctttgctcaggtttccagcccaaggtgcagagccgtctggtggggggcagcagcatctgtgaaggcaccgtggaggtgcgccagggggctcagtgggcagccctgtgtgacagctcttcagccaggagctcgctgcggtgggaggaggtgtgccgggagcagcagtgtggcagcgtcaactcctatcgagtgctggacgctggtgacccaacatcccgggggctcttctgtccccatcagaagctgtcccagtgccacgaactttgggagagaaattcctactgcaagaaggtgtttgtcacatgccaggatccaaaccccgcaggcctggccgcaggcacggtggcaagcatcatcctggccctggtgctcctggtggtgctgctggtcgtgtgcggcccccttgcctacaagaagctagtgaagaaattccgccagaagaagcagcgccagtggattggcccaacgggaatgaaccaaaacatgtctttccatcgcaaccacacggcaaccgtccgatcccatgctgagaaccccacagcctcccacgtggataacgaatacagccaacctcccaggaactcccgcctgtcagcttatccagctctggaaggggctctgcatcgctcctccatgcagcctgacaactcctccgacagtgactatgatctgcatggggctcagaggctgtaaagaactgggatccatgagcaaaaagccgagagccagacctgtttgtcctgagaaaactgtccgctcttcacttgaaatcatgtccctatttctaccccggccagaacatggacagaggccagaagccttccggacaggcgctgctgccccgagtggcaggccagctcacactctgctgcacaacagctcggccgcccctccacttgtggaagctgtggtgggcagagccccaaaacaagcagccttccaactagagactcgggggtgtctgaagggggccccctttccctgcccgctggggagcggcgtctcagtgaaatcggctttctcctcagactctgtccctggtaaggagtgacaaggaagctcacagctgggcgagtgcattttgaatagttttttgtaagtagtgcttttcctccttcctgacaaatcgagcgctttggcctcttctgtgcagcatccacccctgcggatccctctggggaggacaggaaggggactcccggagacctctgcagccgtggtggtcagaggctgctcacctgagcacaaagacagctctgcacattcaccgcagctgccagccaggggtctgggtgggcaccaccctgacccacagcgtcaccccactccctctgtcttatgactcccctccccaaccccctcatctaaagacaccttcctttccactggctgtcaagcccacagggcaccagtgccacccagggcccggcacaaaggggcgcctagtaaaccttaaccaacttggttttttgcttcacccagcaattaaaagtcccaagctgaggtagtttcagtccatcacagttcatcttctaacccaagagtcagagatggggctggtcatgttcctttggtttgaataactcccttgacgaaaacagactcctctagtacttggagatcttggacgtacacctaatcccatggggcctcggcttccttaactgcaagtgagaagaggaggtctacccaggagcctcgggtctgatcaagggagaggccaggcgcagctcactgcggcggctccctaagaaggtgaagcaacatgggaacacatcctaagacaggtcctttctccacgccatttgatgctgtatctcctgggagcacaggcatcaatggtccaagccgcataataagtctggaagagcaaaagggagttactaggatatggggtgggctgctcccagaatctgctcagctttctgcccccaccaacaccctccaaccaggccttgccttctgagagcccccgtggccaagcccaggtcacagatcttcccccgaccatgctgggaatccagaaacagggaccccatttgtcttcccatatctggtggaggtgagggggctcctcaaaagggaactgagaggctgctcttagggagggcaaaggttcgggggcagccagtgtctcccatcagtgccttttttaataaaagctctttcatctatagtttggccaccatacagtggcctcaaagcaaccatggcctacttaaaaaccaaaccaaaaataaagagtttagttgaggagaaa

SEQ ID NO: 1323 - DNA, 1566 bp, Homo sapiens
  misc_feature (1)...(1566): n = A,T,C or G
ctagaagagcaagcccgccagnantgatgaaaactgattttcctggagaccttggcagtcagcgacaagctattccaacaactaagagatcaggactccagtagcagtgagttctgcaccttctggtgacagtgagggtgatgaagaggagacgacacaagatgaagtctcttcccacacatcagaggaagatggaggggtggtcaaagtggagaaagagttagaaaatacagaacagcctgttggtgggaacgaagkgttagagcacgaggtcacagggaatttgaattctgaccccttgcttgaactctgccagtgtcccctctgccagctagactgcgggaccgggagcagttgattgctcacgtgtaccagcacactgcagcagtggtgagcgccaagagctacatgtgtcctgtctgtggccgggcccttagctccccggggtcattgggtcgccacctcttaatccactcggaggaccagcgatctaactgtgctgtgtgtggagcccggttcaccagccatgccacttttaacagtgagaaacttcctgaagtactaaatatggaatccctacccacagtccacaatgagggtccctccagtgctgaggggaaggatattgcctttagtcctccagtgtaccctgctggaattctgcttgtgtgcaacaactgtgctgcctaccgtaaamtgctggaagcccagactcccagtgtasgcaagtgggctctacgtcgacagaatgagcctttggaagtacggctgcagcggctggaacgagagcgcacggccaagaagagccggcgggacaatgagacccccgaggagcgggaggtgaggcgcatgagggaccgtgaagccaagcgcttgcagcgcatgcaggagacagacgagcagcgggcacgccggctgcagcgggatcgggaggccatgaggctgaagcgggccaatgaaaccccggaaaagcggcaggcccggctcatccgagagcgagaggccaagcggctcaagaggaggctggagaaaatggacatgatgttgcgagctcagtttggccaggacccttctgccatggcagccttagcagctgaaatgaacttcttccagctgcctgtaagtggggtggagttggacarccagcttctgggcaagatggcctttgaagagcagaacagcagytytctgcactgaaccacaccctcctgcctgccctccttcccacctacctacccacccacccacacccacagccacgaggaccagtgctgctgccacccacgaggccctgtccttgctgccagaggcaggcctgggtttattgcaggtggacctgagcagcccttgcatatgggaacaggatgatggggtcaggagggacctggctcaaggcagctctggacaagggagcaggcagtccagagaactggcctccccagcccactgccacaggctgtgcttctaggactgtgggcccctgtgtggcccatgaagttgtgaagtcaaataaattaattttatctttaaaaaaaaaaaaaaaaaayyggggggtttttttggggg

SEQ ID NO: 1324 - DNA, 7296 bp, Homo sapiens
gtcctggctataagtcaccatggcacagcaagctgccgataagtatctctatgtggataaaaacttcatcaacaatccgctggcccaggccgactgggctgccaagaagctggtatgggtgccttccgacaagagtggctttgagccagccagcctcaaggaggaggtgggcgaagaggccatcgtggagctggtggagaatgggaagaaggtgaaggtgaacaaggatgacatccagaagatgaacccgcccaagttctccaaggtggaggacatggcagagctcacgtgcctcaacgaagcctcggtgctgcacaacctcaaggagcgttactactcagggctcatctacacctattcaggcctgttctgtgtggtcatcaatccttacaagaacctgcccatctactctgaagagattgtggaaatgtacaagggcaagaagaggcacgagatgccccctcacatctatgccatcacagacaccgcctacaggagtatgatgcaagaccgagaagatcaatccatcttgtgcactggtgaatctggagctggcaagacggagaacaccaagaaggtcatccagtatctggcgtacgtggcgtcctcgcacaagagcaagaaggaccagggcgagctggagcggcagctgctgcaggccaaccccatcctggaggccttcgggaacgccaagaccgtgaagaatgacaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacatggcccgggcccaggcagagagccaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatacttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgctacgagcc

SEQ ID NO: 1325 - DNA, 7234 bp, Homo sapiens
cgcggttcctgggcagggcacggaaggctaagcaaggctgacctgctgcagctcccgcctcgtgcgctcgccccacccggccgccgcccgagcgctcgagaaagtcctctcgggagaagcagcgcctgttcccggggcagatccaggttcaggtcctggctataagtcaccatggcacagcaagctgccgataagtatctctatgtggataaaaacttcatcaacaatccgctggcccaggccgactgggctgccaagaagctggtatgggtgccttccgacaagagtggctttgagccagccagcctcaaggaggaggtgggcgaagaggccatcgtggagctggtggagaatgggaagaaggtgaaggtgaacaaggatgacatccagaagatgaacccgcccaagttctccaaggtggaggacatggcagagctcacgtgcctcaacgaagcctcggtgctgcacaacctcaaggagcgttactactcagggctcatctacacctattcaggcctgttctgtgtggtcatcaatccttacaagaacctgcccatctactctgaagagattgtggaaatgtacaagggcaagaagaggcacgagatgccccctcacatctatgccatcacagacaccgcctacaggagtatgatgcaagaccgagaagatcaatccatcttgtgcactggtgaatctggagctggcaagacggagaacaccaagaaggtcatccagtatctggcgtacgtggcgtcctcgcacaagagcaagaaggaccagggcgagctggagcggcagctgctgcaggccaaccccatcctggaggccttcgggaacgccaagaccgtgaagaatgacaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacatggcccgggcccaggcagagagccaccagcaggctcctcagtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatacttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaacc

SEQ ID NO: 1326 - DNA, 7448 bp, Homo sapiens
cgcggttcctgggcagggcacggaaggctaagcaaggctgacctgctgcagctcccgcctcgtgcgctcgccccacccggccgccgcccgagcgctcgagaaagtcctctcgggagaagcagcgcctgttcccggggcagatccaggttcaggtcctggctataagtcaccatggcacagcaagctgccgataagtatctctatgtggataaaaacttcatcaacaatccgctggcccaggccgactgggctgccaagaagctggtatgggtgccttccgacaagagtggctttgagccagccagcctcaaggaggaggtgggcgaagaggccatcgtggagctggtggagaatgggaagaaggtgaaggtgaacaaggatgacatccagaagatgaacccgcccaagttctccaaggtggaggacatggcagagctcacgtgcctcaacgaagcctcggtgctgcacaacctcaaggagcgttactactcagggctcatctacacctattcaggcctgttctgtgtggtcatcaatccttacaagaacctgcccatctactctgaagagattgtggaaatgtacaagggcaagaagaggcacgagatgccccctcacatctatgccatcacagacaccgcctacaggagtatgatgcaagaccgagaagatcaatccatcttgtgcactggtgaatctggagctggcaagacggagaacaccaagaaggtcatccagtatctggcgtacgtggcgtcctcgcacaagagcaagaaggaccagggcgagctggagcggcagctgctgcaggccaaccccatcctggaggccttcgggaacgccaagaccgtgaagaatgacaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacatggcccgggcccaggcagagagccaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatacttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgctacgagcc

SEQ ID NO: 1327 - DNA, 920 bp, Homo sapiens
gcacggaggggcagagaccccggagccccagccccaccatgaccctcggccgccgactcgcgtgtcttttcctcgcctgtgtcctgccggccttgctgctggggggcaccgcgctggcctcggagattgtggggggccggcgagcgcggccccacgcgtggcccttcatggtgtccctgcagctgcgcggaggccacttctgcggcgccaccctgattgcgcccaacttcgtcatgtcggccgcgcactgcgtggcgaatgtaaacgtccgcgcggtgcgggtggtcctgggagcccataacctctcgcggcgggagcccacccggcaggtgttcgccgtgcagcgcatcttcgaaaacggctacgaccccgtaaacttgctcaacgacatcgtgattctccagctcaacgggtcggccaccatcaacgccaacgtgcaggtggcccagctgccggctcagggacgccgcctgggcaacggggtgcagtgcctggccatgggctggggccttctgggcaggaaccgtgggatcgccagcgtcctgcaggagctcaacgtgacggtggtgacgtccctctgccgtcgcagcaacgtctgcactctcgtgaggggccggcaggccggcgtctgtttcggggactccggcagccccttggtctgcaacgggctaatccacggaattgcctccttcgtccggggaggctgcgcctcagggctctaccccgatgcctttgccccggtggcacagtttgtaaactggatcgactctatcatccaacgctccgaggacaacccctgtccccacccccgggacccggacccggccagcaggacccactgagaagggctgcccgggtcacctcagctgcccacacccacactctccagcatctggcacaataaacattctctgttttgt

SEQ ID NO: 1328 - DNA, 985 bp, Homo sapiens
gcgctggccggccgtggggcaatgcaacggcctcccagcacagggctataagaggagccgggcgggcacggaggggcagagaccccggagccccagccccaccatgaccctcggccgccgactcgcgtgtcttttcctcgcctgtgtcctgccggccttgctgctggggggcaccgcgctggcctcggagattgtggggggccggcgagcgcggccccacgcgtggcccttcatggtgtccctgcagctgcgcggaggccacttctgcggcgccaccctgattgcgcccaacttcgtcatgtcggccgcgcactgcgtggcgaatgtaaacgtccgcgcggtgcgggtggtcctgggagcccataacctctcgcggcgggagcccacccggcaggtgttcgccgtgcagcgcatcttcgaaaacggctacgaccccgtaaacttgctcaacgacatcgtgattctccagctcaacgggtcggccaccatcaacgccaacgtgcaggtggcccagctgccggctcagggacgccgcctgggcaacggggtgcagtgcctggccatgggctggggccttctgggcaggaaccgtgggatcgccagcgtcctgcaggagctcaacgtgacggtggtgacgtccctctgccgtcgcagcaacgtctgcactctcgtgaggggccggcaggccggcgtctgtttcggggactccggcagccccttggtctgcaacgggctaatccacggaattgcctccttcgtccggggaggctgcgcctcagggctctaccccgatgcctttgccccggtggcacagtttgtaaactggatcgactctatcatccaacgctccgaggacaacccctgtccccacccccgggacccggacccggccagcaggacccactgagaagggctgcccgggtcacctcagctgcccacacccacactctccagcatctggcacaataaacattctctgttttgt

SEQ ID NO: 1329 - DNA, 1956 bp, Homo sapiens
gaagtagggcgtgtggcgtcacttccggcttccttcagtccgctggtcccgagcacgagctgtgaggggattcacttgtgtgcggaactcctcggaaccatggcgtccctttcccttgcacctgttaacatctttaaggcaggagctgatgaagagagagcagagacagctcgtctgacttcttttattggtgccatcgccattggagacttggtaaagagcaccttgggacccaaaggcatggacaaaattcttctaagcagtggacgagatgcctctcttatggtaaccaatgatggtgccactattctaaaaaacattggtgttgacaatccagcagctaaagttttagttgatatgtcaagggttcaagatgatgaagttggtgatggcactacctctgttaccgttttagcagcagaattattaagggaagcagaatctttaattgcaaaaaagattcatccacagaccatcatagcgggttggagagaagccacgaaggctgcaagagaggcgctgttgagttctgcagttgatcatggttccgatgaagttaaattccgtcaagatttaatgaatattgcgggcacaacattatcctcaaaacttcttactcatcacaaagaccactttacaaagttagctgtagaagcagttctcagactgaaaggctctggcaacctggaggcaattcatattatcaagaagctaggaggaagtttggcagattcctatttagatgaaggcttcctgttggataaaaaaattggagtaaatcaaccaaaacgaattgaaaatgctaaaattcttattgcaaatactggtatggatacagacaaaataaagatatttggttcccgggtaagagttgactctacagcaaaggttgcagaaatagaacatgcggaaaaggaaaaaatgaaggagaaagttgaacgtattcttaagcatggaataaattgctttattaacaggcaattaatttataattatcctgaacagctctttggtgctgctggtgtcatggctattgagcatgcagattttgcaggtgtggaacgcctagctcttgtcacaggtggtgaaattgcctctacctttgatcacccagaactggtgaagcttggaagttgcaaacttatcgaggaagtcatgattggagaagacaaactcattcacttttctggggttgcccttggtgaggcttgtaccattgttttgcgtggtgccactcaacaaattttagatgaagcagaaagatcattgcatgatgctctttgtgttcttgcgcaaactgtaaaggactctagaacagtttatggaggaggctgttctgagatgttgatggctcatgctgtgacacagcttgccaatagaacaccaggcaaagaagctgttgcaatggagtcttatgctaaagcactgagaatgttgccaaccatcatagctgacaatgcaggctatgacagtgcagacctggtggcacagctcagggctgctcacagtgaaggcaataccactgctggattggatatgagggaaggcaccattggagatatggctatcctgggtataacagaaagttttcaagtgaagcgacaggttcttctgagtgcagctgaagcagcagaggtgattctgcgtgtggacaacatcatcaaagcggcacccaggaaacgtgtccctgatcaccacccctgttaagcattcccacgtgctgtcgatctttggaccagtttctagcaaagttgtgtttgaaagatactctattaaagaagactgtggaatctgtttatcggtgcccattatatccttaagtttggatatttagctgaccttcgctttaacataggtctaatttatttgccgtgtcattttccatacaaatcagttgatttaaaaaagttcatttctcatactgtgcattaaaataaaaatttgaacaattacttg

SEQ ID NO: 1330 - DNA, 1902 bp, Homo sapiens
gggattcacttgtgtgcggaactcctcggaaccatggcgtccctttcccttgcacctgttaacatctttaaggcaggagctgatgaagagagagcagagacagctcgtctgacttcttttattggtgccatcgccattggagacttggtaaagagcaccttgggacccaaaggcatggacaaaattcttctaagcagtggacgagatgcctctcttatggtaaccaatgatggtgccactattctaaaaaacattggtgttgacaatccagcagctaaagttttagttgatatgtcaagggttcaagatgatgaagttggtgatggcactacctctgttaccgttttagcagcagaattattaagggaagcagaatctttaattgcaaaaaagattcatccacagaccatcatagcgggttggagagaagccacgaaggctgcaagagaggcgctgttgagttctgcagttgatcatggttccgatgaagttaaattccgtcaagatttaatgaatattgcgggcacaacattatcctcaaaacttcttactcatcacaaagaccactttacaaagttagctgtagaagcagttctcagactgaaaggctctggcaacctggaggcaattcatattatcaagaagctaggaggaagtttggcagattcctatttagatgaaggcttcctgttggataaaaaaattggagtaaatcaaccaaaacgaattgaaaatgctaaaattcttattgcaaatactggtatggatacagacaaaataaagatatttggttcccgggtaagagttgactctacagcaaaggttgcagaaatagaacatgcggaaaaggaaaaaatgaaggagaaagttgaacgtattcttaagcatggaataaattgctttattaacaggcaattaatttataattatcctgaacagctctttggtgctgctggtgtcatggctattgagcatgcagattttgcaggtgtggaacgcctagctcttgtcacaggtggtgaaattgcctctacctttgatcacccagaactggtgaagcttggaagttgcaaacttatcgaggaagtcatgattggagaagacaaactcattcacttttctggggttgcccttggtgaggcttgtaccattgttttgcgtggtgccactcaacaaattttagatgaagcagaaagatcattgcatgatgctctttgtgttcttgcgcaaactgtaaaggactctagaacagtttatggaggaggctgttctgagatgttgatggctcatgctgtgacacagcttgccaatagaacaccaggcaaagaagctgttgcaatggagtcttatgctaaagcactgagaatgttgccaaccatcatagctgacaatgcaggctatgacagtgcagacctggtggcacagctcagggctgctcacagtgaaggcaataccactgctggattggatatgagggaaggcaccattggagatatggctatcctgggtataacagaaagttttcaagtgaagcgacaggttcttctgagtgcagctgaagcagcagaggtgattctgcgtgtggacaacatcatcaaagcggcacccaggaaacgtgtccctgatcaccacccctgttaagcattcccacgtgctgtcgatctttggaccagtttctagcaaagttgtgtttgaaagatactctattaaagaagactgtggaatctgtttatcggtgcccattatatccttaagtttggatatttagctgaccttcgctttaacataggtctaatttatttgccgtgtcattttccatacaaatcagttgatttaaaaaagttcatttctcatactgtgcattaaaataaaaatttgaacaattaaaaaaaaaaaaaaaaa

SEQ ID NO: 1331 - DNA, 2764 bp, Homo sapiens
aaaaaactgaaaaagttgaaagcagttttcctggagacaggaagtggtgaggcagataaattatgtttttccttattggtatataacactttaaactgtgtacatgtgtgactttaatagaagtgtttaaagattaaatttaagaaaataaaaagtgtgagcaagaactccatttctatggcaacccgcgcggcagccgcctctttgttctggagcggcggccacgccccctccagtgtgaaaggctgcgtttccggcccgtggggctccaatcaaaatgggacgcctgctggcggtaacgacaggccggggccccgccccccgaagtagggcgtgtggcgtcacttccggcttccttcagtccgctggtcccgagcacgagctgtgaggggattcacttgtgtgcggaactcctcggaaccatggtgagcctgactcccctgcctcttgccctacccctgctccgccgtgctcttgccaccccactgcttcctctgtcctgctagggtcgtaggctccgtttctgtctccccggccctccgcacatggtgcgagccatgcgcggggcgtgcggcctgcgccaggccagccggtggagctcaccacgagggggaggggtggaccgcaaagccagcgtctccttgtgcctaggtctttgcatagtcccggcagcccaggtccgcgcctcacccggagcgaagaaatttctagtgtgggacccgctccgccctccttctaggggcggagcctggagcgacggggtctgagccatcagagggtggaggggccgcagccttccgagggtggaagatggaggccgcgttccctcgcccgcccggcaggcgtcaccttgatggcctgcaacccctccctgcctcattcttagttcaagatcgtctttagtctcgctgcgtccctttcccttgcacctgttaacatctttaaggcaggagctgatgaagagagagcagagacagctcgtctgacttcttttattggtgccatcgccattggagacttggtaaagagcaccttgggacccaaaggcatggacaaaattcttctaagcagtggacgagatgcctctcttatggtaaccaatgatggtgccactattctaaaaaacattggtgttgacaatccagcagctaaagttttagttgatatgtcaagggttcaagatgatgaagttggtgatggcactacctctgttaccgttttagcagcagaattattaagggaagcagaatctttaattgcaaaaaagattcatccacagaccatcatagcgggttggagagaagccacgaaggctgcaagagaggcgctgttgagttctgcagttgatcatggttccgatgaagttaaattccgtcaagatttaatgaatattgcgggcacaacattatcctcaaaacttcttactcatcacaaagaccactttacaaagttagctgtagaagcagttctcagactgaaaggctctggcaacctggaggcaattcatattatcaagaagctaggaggaagtttggcagattcctatttagatgaaggcttcctgttggataaaaaaattggagtaaatcaaccaaaacgaattgaaaatgctaaaattcttattgcaaatactggtatggatacagacaaaataaagatatttggttcccgggtaagagttgactctacagcaaaggttgcagaaatagaacatgcggaaaaggaaaaaatgaaggagaaagttgaacgtattcttaagcatggaataaattgctttattaacaggcaattaatttataattatcctgaacagctctttggtgctgctggtgtcatggctattgagcatgcagattttgcaggtgtggaacgcctagctcttgtcacaggtggtgaaattgcctctacctttgatcacccagaactggtgaagcttggaagttgcaaacttatcgaggaagtcatgattggagaagacaaactcattcacttttctggggttgcccttggtgaggcttgtaccattgttttgcgtggtgccactcaacaaattttagatgaagcagaaagatcattgcatgatgctctttgtgttcttgcgcaaactgtaaaggactctagaacagtttatggaggaggctgttctgagatgttgatggctcatgctgtgacacagcttgccaatagaacaccaggcaaagaagctgttgcaatggagtcttatgctaaagcactgagaatgttgccaaccatcatagctgacaatgcaggctatgacagtgcagacctggtggcacagctcagggctgctcacagtgaaggcaataccactgctggattggatatgagggaaggcaccattggagatatggctatcctgggtataacagaaagttttcaagtgaagcgacaggttcttctgagtgcagctgaagcagcagaggtgattctgcgtgtggacaacatcatcaaagcggcacccaggaaacgtgtccctgatcaccacccctgttaagcattcccacgtgctgtcgatctttggaccagtttctagcaaagttgtgtttgaaagatactctattaaagaagactgtggaatctgtttatcggtgcccattatatccttaagtttggatatttagctgaccttcgctttaacataggtctaatttatttgccgtgtcattttccatacaaatcagttgatttaaaaaagttcatttctcatactgtgcattaaaataaaaatttgaacaattacttg

SEQ ID NO: 1332 - protein, 6 aa, Homo sapiens
AAPECK

SEQ ID NO: 1333 - protein, 8 aa, Homo sapiens
AAVDTYCR

SEQ ID NO: 1334 - protein, 17 aa, Homo sapiens
ACANPAAGSVILLENLR

SEQ ID NO: 1335 - protein, 7 aa, Homo sapiens
ACQLVNR

SEQ ID NO: 1336 - protein, 20 aa, Homo sapiens
AGFVGGQFWSVYTPCDTQNK

SEQ ID NO: 1337 - protein, 13 aa, Homo sapiens
AGSPTLLNCLMYK

SEQ ID NO: 1338 - protein, 11 aa, Homo sapiens
AHVVPCFDASK

SEQ ID NO: 1339 - protein, 8 aa, Homo sapiens
AKFENLCK

SEQ ID NO: 1340 - protein, 18 aa, Homo sapiens
ALEHVDGTHVCQLPEDQK

SEQ ID NO: 1341 - protein, 15 aa, Homo sapiens
ALNEACESVIQTACK

SEQ ID NO: 1342 - protein, 17 aa, Homo sapiens
APVIFSHSSAYSVCASR

SEQ ID NO: 1343 - protein, 12 aa, Homo sapiens
ARFEELCSDLFR

SEQ ID NO: 1344 - protein, 11 aa, Homo sapiens
AVIFCLSADKK

SEQ ID NO: 1345 - protein, 12 aa, Homo sapiens
AVLLVGLCDSGK

SEQ ID NO: 1346 - protein, 9 aa, Homo sapiens
AVVMISCNR

SEQ ID NO: 1347 - protein, 12 aa, Homo sapiens
AYLEGLCVEWLR

SEQ ID NO: 1348 - protein, 19 aa, Homo sapiens
CAPGVVGPAEADIDFDIIR

SEQ ID NO: 1349 - protein, 9 aa, Homo sapiens
CDDLEALKK

SEQ ID NO: 1350 - protein, 13 aa, Homo sapiens
CDGLIDSLVHYVR

SEQ ID NO: 1351 - protein, 6 aa, Homo sapiens
CDMDDK

SEQ ID NO: 1352 - protein, 10 aa, Homo sapiens
CETQNPVSAR

SEQ ID NO: 1353 - protein, 11 aa, Homo sapiens
CGPMVLDALIK

SEQ ID NO: 1354 - protein, 8 aa, Homo sapiens
CGVLGALR

SEQ ID NO: 1355 - protein, 11 aa, Homo sapiens
CIESLIAVFQK

SEQ ID NO: 1356 - protein, 11 aa, Homo sapiens
CKIPALDLLIK

SEQ ID NO: 1357 - protein, 9 aa, Homo sapiens
CLAALASLR

SEQ ID NO: 1358 - protein, 9 aa, Homo sapiens
CLIEILASR

SEQ ID NO: 1359 - protein, 10 aa, Homo sapiens
CMQLTDFILK

SEQ ID NO: 1360 - protein, 10 aa, Homo sapiens
CPDACNAQHK

SEQ ID NO: 1361 - protein, 11 aa, Homo sapiens
CQNALQQVVAR

SEQ ID NO: 1362 - protein, 10 aa, Homo sapiens
CRFPVVENGK

SEQ ID NO: 1363 - protein, 12 aa, Homo sapiens
CSGPGLSPGMVR

SEQ ID NO: 1364 - protein, 14 aa, Homo sapiens
CSTSPLLEACEFLR

SEQ ID NO: 1365 - protein, 9 aa, Homo sapiens
CVLPHMIER

SEQ ID NO: 1366 - protein, 15 aa, Homo sapiens
DCHLAQVPSHTVVAR

SEQ ID NO: 1367 - protein, 17 aa, Homo sapiens
DFVNCSTLPALNLASWR

SEQ ID NO: 1368 - protein, 9 aa, Homo sapiens
DGFVCALLR

SEQ ID NO: 1369 - protein, 11 aa, Homo sapiens
DIIACGFDINK

SEQ ID NO: 1370 - protein, 11 aa, Homo sapiens
DILPCLDGYLK

SEQ ID NO: 1371 - protein, 14 aa, Homo sapiens
DKPLKDVIIADCGK

SEQ ID NO: 1372 - protein, 9 aa, Homo sapiens
DTEITCSER

SEQ ID NO: 1373 - protein, 15 aa, Homo sapiens
DVCTELLPLIKPQGR

SEQ ID NO: 1374 - protein, 11 aa, Homo sapiens
EFHGLGDCIIK

SEQ ID NO: 1375 - protein, 13 aa, Homo sapiens
EGSPVLLNCLMYK

SEQ ID NO: 1376 - protein, 10 aa, Homo sapiens
EGVVECSFVK

SEQ ID NO: 1377 - protein, 14 aa, Homo sapiens
ELGSECGIEFDEEK

SEQ ID NO: 1378 - protein, 11 aa, Homo sapiens
ELNLSFCEIKR

SEQ ID NO: 1379 - protein, 23 aa, Homo sapiens
EMLSHESGRHSFLQRDCEYPTLR

SEQ ID NO: 1380 - protein, 13 aa, Homo sapiens
ESLCQAALGLILK

SEQ ID NO: 1381 - protein, 13 aa, Homo sapiens
ETCISFIKDFLAK

SEQ ID NO: 1382 - protein, 18 aa, Homo sapiens
EVLGSLPNVFSALCLNAR

SEQ ID NO: 1383 - protein, 13 aa, Homo sapiens
EYLPIGGLAEFCK

SEQ ID NO: 1384 - protein, 18 aa, Homo sapiens
FCGLPQPETVGQLGTVLR

SEQ ID NO: 1385 - protein, 12 aa, Homo sapiens
FEHCNFNDVTTR

SEQ ID NO: 1386 - protein, 9 aa, Homo sapiens
FHLCSVPTR

SEQ ID NO: 1387 - protein, 16 aa, Homo sapiens
FLQMCNDDPDVLPDLK

SEQ ID NO: 1388 - protein, 9 aa, Homo sapiens
FNNYVDCMK

SEQ ID NO: 1389 - protein, 25 aa, Homo sapiens
FPKPESQPVIKTYLSWRWLTTCLSR

SEQ ID NO: 1390 - protein, 19 aa, Homo sapiens
FVLSGANIMCPGLTSPGAK

SEQ ID NO: 1391 - protein, 6 aa, Homo sapiens
FVNCVR

SEQ ID NO: 1392 - protein, 9 aa, Homo sapiens
GACILNMLR

SEQ ID NO: 1393 - protein, 17 aa, Homo sapiens
GCITIIGGGDTATCCAK

SEQ ID NO: 1394 - protein, 10 aa, Homo sapiens
GGCILCGYLK

SEQ ID NO: 1395 - protein, 20 aa, Homo sapiens
GGLGGPRTGGSCEGAISWPK

SEQ ID NO: 1396 - protein, 8 aa, Homo sapiens
GIFPVLCK

SEQ ID NO: 1397 - protein, 16 aa, Homo sapiens
GPGLFFILPCTDSFIK

SEQ ID NO: 1398 - protein, 17 aa, Homo sapiens
GQDHCGIESEVVAGIPR

SEQ ID NO: 1399 - protein, 21 aa, Homo sapiens
GSWGTVCDDSWDTNDANVVCR

SEQ ID NO: 1400 - protein, 14 aa, Homo sapiens
GTINFLHADCDKFR

SEQ ID NO: 1401 - protein, 16 aa, Homo sapiens
GVLFGVPGAFTPGCSK

SEQ ID NO: 1402 - protein, 12 aa, Homo sapiens
GWTLTDADVVCR

SEQ ID NO: 1403 - protein, 15 aa, Homo sapiens
HFCPNVPIILVGNKK

SEQ ID NO: 1404 - protein, 22 aa, Homo sapiens
HGEVCPAGWKPGSDTIKPDVQK

SEQ ID NO: 1405 - protein, 13 aa, Homo sapiens
HGFCGIPITDTGR

SEQ ID NO: 1406 - protein, 17 aa, Homo sapiens
HLNEIDLFHCIDPNDSK

SEQ ID NO: 1407 - protein, 27 aa, Homo sapiens
HTGPGILSMANAGPNTNGSQFFICTAK

SEQ ID NO: 1408 - protein, 16 aa, Homo sapiens
HTYLPLEVCNIVAGQR

SEQ ID NO: 1409 - protein, 15 aa, Homo sapiens
IATGHNIIDELPPCK

SEQ ID NO: 1410 - protein, 7 aa, Homo sapiens
ICLDILK

SEQ ID NO: 1411 - protein, 14 aa, Homo sapiens
IECDDKGDGSCDVR

SEQ ID NO: 1412 - protein, 7 aa, Homo sapiens
IFQALCK

SEQ ID NO: 1413 - protein, 20 aa, Homo sapiens
IGSSELQEFCPTILQQLDSR

SEQ ID NO: 1414 - protein, 13 aa, Homo sapiens
IICDNTGITTVSK

SEQ ID NO: 1415 - protein, 17 aa, Homo sapiens
IIKPCNHVLSLSFPIRR

SEQ ID NO: 1416 - protein, 28 aa, Homo sapiens
ILNHVLQHAEPGNAQSVLEAIDTYCEQK

SEQ ID NO: 1417 - protein, 6 aa, Homo sapiens
INCQGK

SEQ ID NO: 1418 - protein, 9 aa, Homo sapiens
IPACIAGER

SEQ ID NO: 1419 - protein, 10 aa, Homo sapiens
IPCFLAGDTR

SEQ ID NO: 1420 - protein, 14 aa, Homo sapiens
IQNSSCTSLEHCFR

SEQ ID NO: 1421 - protein, 12 aa, Homo sapiens
IVGPSGAAVPCK

SEQ ID NO: 1422 - protein, 6 aa, Homo sapiens
KCILPK

SEQ ID NO: 1423 - protein, 18 aa, Homo sapiens
KFHYLPFLPSTEDVYDCR

SEQ ID NO: 1424 - protein, 19 aa, Homo sapiens
KFIQENIFGICPHMTEDNK

SEQ ID NO: 1425 - protein, 12 aa, Homo sapiens
KGDECELLGHSK

SEQ ID NO: 1426 - protein, 17 aa, Homo sapiens
KMEDSVGCLETAEEVKR

SEQ ID NO: 1427 - protein, 15 aa, Homo sapiens
KNTDLYHCLLEHLQR

SEQ ID NO: 1428 - protein, 6 aa, Homo sapiens
LCFSAK

SEQ ID NO: 1429 - protein, 13 aa, Homo sapiens
LCLISTFLEDGIR

SEQ ID NO: 1430 - protein, 10 aa, Homo sapiens
LDFVCSFLQK

SEQ ID NO: 1431 - protein, 17 aa, Homo sapiens
LGNGVQCLAMGWGLLGR

SEQ ID NO: 1432 - protein, 9 aa, Homo sapiens
LICEPYTSK

SEQ ID NO: 1433 - protein, 11 aa, Homo sapiens
LKTEGSDLCDR

SEQ ID NO: 1434 - protein, 17 aa, Homo sapiens
LLASALQTHGFHPCWPR

SEQ ID NO: 1435 - protein, 11 aa, Homo sapiens
LLCGGGIAADR

SEQ ID NO: 1436 - protein, 9 aa, Homo sapiens
LLCGLLAER

SEQ ID NO: 1437 - protein, 6 aa, Homo sapiens
LLLCAR

SEQ ID NO: 1438 - protein, 32 aa, Homo sapiens
LNKPFLFDTKPLIVQYEVNFQNGIECGGAYVK

SEQ ID NO: 1439 - protein, 9 aa, Homo sapiens
LPVLAGCLK

SEQ ID NO: 1440 - protein, 25 aa, Homo sapiens
LRCTQLPAITSSRPGPRGQVLLYTR

SEQ ID NO: 1441 - protein, 21 aa, Homo sapiens
LRPLFEACGEVVQIRPIFSNR

SEQ ID NO: 1442 - protein, 9 aa, Homo sapiens
LTCFELAPK

SEQ ID NO: 1443 - protein, 12 aa, Homo sapiens
LTFEQVYSDCKK

SEQ ID NO: 1444 - protein, 7 aa, Homo sapiens
MCYLTIK

SEQ ID NO: 1445 - protein, 13 aa, Homo sapiens
MLLCEAVAAVMAK

SEQ ID NO: 1446 - protein, 27 aa, Homo sapiens
MSASQLEALCPQVINAALALAAKPQSK

SEQ ID NO: 1447 - protein, 7 aa, Homo sapiens
MSCMDNK

SEQ ID NO: 1448 - protein, 11 aa, Homo sapiens
MYACDVGPDGR

SEQ ID NO: 1449 - protein, 23 aa, Homo sapiens
NLNTLCWAIGSISGAMHEEDEKR

SEQ ID NO: 1450 - protein, 11 aa, Homo sapiens
NLSGQPNFPCR

SEQ ID NO: 1451 - protein, 18 aa, Homo sapiens
NPMDYPVEDAFCKPQLVK

SEQ ID NO: 1452 - protein, 10 aa, Homo sapiens
NQADCIPFFR

SEQ ID NO: 1453 - protein, 10 aa, Homo sapiens
NQVSLTCLVK

SEQ ID NO: 1454 - protein, 14 aa, Homo sapiens
NTDLYHCLLEHLQR

SEQ ID NO: 1455 - protein, 15 aa, Homo sapiens
QLGCGWAMSAPGNAR

SEQ ID NO: 1456 - protein, 10 aa, Homo sapiens
QLVTNACLIK

SEQ ID NO: 1457 - protein, 7 aa, Homo sapiens
SCEVPTR

SEQ ID NO: 1458 - protein, 8 aa, Homo sapiens
SCHTAVDR

SEQ ID NO: 1459 - protein, 11 aa, Homo sapiens
SCLLLQFTDKR

SEQ ID NO: 1460 - protein, 15 aa, Homo sapiens
SCSSSCAVHDLIFWR

SEQ ID NO: 1461 - protein, 19 aa, Homo sapiens
SDLQRPNPQSPFCVASSLK

SEQ ID NO: 1462 - protein, 11 aa, Homo sapiens
SEDCFILDHGK

SEQ ID NO: 1463 - protein, 13 aa, Homo sapiens
SGILPILVHCLER

SEQ ID NO: 1464 - protein, 15 aa, Homo sapiens
SIAQYWLGCPAPGHL

SEQ ID NO: 1465 - protein, 10 aa, Homo sapiens
SICEVLDLER

SEQ ID NO: 1466 - protein, 21 aa, Homo sapiens
SLGLPENHIVFPVPIDQCIDG

SEQ ID NO: 1467 - protein, 17 aa, Homo sapiens
SLGTIQQCCDAIDHLCR

SEQ ID NO: 1468 - protein, 14 aa, Homo sapiens
SLHDALCVLAQTVK

SEQ ID NO: 1469 - protein, 21 aa, Homo sapiens
SSLNDPLCLVHPSSETCNSIR

SEQ ID NO: 1470 - protein, 18 aa, Homo sapiens
TAGTICLETFKDFPQMGR

SEQ ID NO: 1471 - protein, 24 aa, Homo sapiens
TCEEHQLCVVAVLPHILDTGAAGR

SEQ ID NO: 1472 - protein, 17 aa, Homo sapiens
TFVPGCQPGEFTLGNIK

SEQ ID NO: 1473 - protein, 12 aa, Homo sapiens
TGGLYSCDITAR

SEQ ID NO: 1474 - protein, 9 aa, Homo sapiens
TPCEEILVK

SEQ ID NO: 1475 - protein, 15 aa, Homo sapiens
TPCTVSCNIPVVSGK

SEQ ID NO: 1476 - protein, 15 aa, Homo sapiens
TPPLLENSLPQCYQR

SEQ ID NO: 1477 - protein, 11 aa, Homo sapiens
TQDECILHFLR

SEQ ID NO: 1478 - protein, 12 aa, Homo sapiens
TQILCSHLEGHR

SEQ ID NO: 1479 - protein, 21 aa, Homo sapiens
TREEECHFYAGGQVYPGEASR

SEQ ID NO: 1480 - protein, 8 aa, Homo sapiens
TVYCNVHK

SEQ ID NO: 1481 - protein, 16 aa, Homo sapiens
VCALYIMAGTVDDVPK

SEQ ID NO: 1482 - protein, 15 aa, Homo sapiens
VEDLTFTSPFCLQVK

SEQ ID NO: 1483 - protein, 13 aa, Homo sapiens
VEGCFNQLLYDIR

SEQ ID NO: 1484 - protein, 12 aa, Homo sapiens
VFVLPCIQQIQR

SEQ ID NO: 1485 - protein, 9 aa, Homo sapiens
VGAFTMVCK

SEQ ID NO: 1486 - protein, 14 aa, Homo sapiens
VGPLLACIIGTQFR

SEQ ID NO: 1487 - protein, 9 aa, Homo sapiens
VGTECGNQK

SEQ ID NO: 1488 - protein, 15 aa, Homo sapiens
VIGIECSSISDYAVK

SEQ ID NO: 1489 - protein, 8 aa, Homo sapiens
VLCTPPPK

SEQ ID NO: 1490 - protein, 15 aa, Homo sapiens
VLVVGAGGIGCELLK

SEQ ID NO: 1491 - protein, 12 aa, Homo sapiens
VPFLVLECPNLK

SEQ ID NO: 1492 - protein, 16 aa, Homo sapiens
VTVAGLAGKDPVQCSR

SEQ ID NO: 1493 - protein, 15 aa, Homo sapiens
WGTDEDKFTEILCLR

SEQ ID NO: 1494 - protein, 12 aa, Homo sapiens
WTELAGCTADFR

SEQ ID NO: 1495 - protein, 12 aa, Homo sapiens
YFSLPFCVGSKK

SEQ ID NO: 1496 - protein, 9 aa, Homo sapiens
YGTCIYQGR

SEQ ID NO: 1497 - protein, 14 aa, Homo sapiens
YLAADKDGNVTCER

SEQ ID NO: 1498 - protein, 11 aa, Homo sapiens
YLLDSCAPLLR

SEQ ID NO: 1499 - protein, 14 aa, Homo sapiens
YNPNVLPVQCTGKR

SEQ ID NO: 1500 - protein, 13 aa, Homo sapiens
YSVFRPGVLLCDR

SEQ ID NO: 1501 - protein, 6 aa, Homo sapiens
YVICVR

The invention claimed is:

1. A method of diagnosing colon cancer in an individual, the method comprising detecting an elevated level of solute carrier family 5, member 1 (SLC5A1) protein in a colon sample from the individual relative to a control SLC5A1 protein level of a non-cancerous colon tissue sample, wherein the elevated level of SLC5A1 protein indicates that said individual has colon cancer, and wherein the SLC5A1 protein comprises the amino acid sequence of SEQ ID NO:651.

2. The method of claim 1, wherein the elevated level of the SLC5A1 protein is detected by contacting the sample from the individual with an isolated antibody that selectively binds to the SLC5A1 protein and detecting binding of the antibody to the SLC5A1 protein.

3. The method of claim 2, wherein the antibody is coupled to a detectable substance.

* * * * *